US011406692B2

(12) United States Patent
Poma et al.

(10) Patent No.: US 11,406,692 B2
(45) Date of Patent: *Aug. 9, 2022

(54) CELL-TARGETING MOLECULES COMPRISING DE-IMMUNIZED, SHIGA TOXIN A SUBUNIT EFFECTORS AND CD8+ T-CELL EPITOPES

(71) Applicant: Molecular Templates, Inc., Austin, TX (US)

(72) Inventors: Eric Poma, New York, NY (US); Erin Willert, Round Rock, TX (US); Sangeetha Rajagopalan, Round Rock, TX (US); Garrett Lee Robinson, Austin, TX (US); Brigitte Brieschke, Austin, TX (US); Jason Kim, Austin, TX (US)

(73) Assignee: Molecular Templates, Inc., Austin, TX (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/228,579

(22) Filed: Apr. 12, 2021

(65) Prior Publication Data

US 2021/0268085 A1 Sep. 2, 2021

Related U.S. Application Data

(63) Continuation of application No. 16/480,591, filed as application No. PCT/US2018/014942 on Jan. 24, 2018, now abandoned.

(60) Provisional application No. 62/450,506, filed on Jan. 25, 2017.

(51) Int. Cl.

| | |
|---|---|
| *C07K 14/25* | (2006.01) |
| *A61K 39/00* | (2006.01) |
| *A61K 47/68* | (2017.01) |

(52) U.S. Cl.

CPC ...... *A61K 39/0011* (2013.01); *A61K 47/6829* (2017.08); *A61K 47/6851* (2017.08); *C07K 14/25* (2013.01); *C07K 2319/33* (2013.01); *C07K 2319/55* (2013.01)

(58) Field of Classification Search

None

See application file for complete search history.

(56) References Cited

U.S. PATENT DOCUMENTS

| | | | |
|---|---|---|---|
| 5,080,898 | A | 1/1992 | Murphy |
| 5,135,736 | A | 8/1992 | Anderson et al. |
| 5,552,144 | A | 9/1996 | Samuel et al. |
| 5,635,384 | A | 6/1997 | Walsh et al. |
| 5,668,255 | A | 9/1997 | Murphy |
| 5,858,682 | A | 1/1999 | Gruenwald et al. |
| 6,022,950 | A | 2/2000 | Murphy |
| 6,080,400 | A | 6/2000 | Williams et al. |
| 6,492,498 | B1 | 12/2002 | Vallera et al. |
| 6,652,857 | B2 | 11/2003 | Williams et al. |
| 6,770,456 | B1 | 8/2004 | Coulie et al. |
| 7,144,991 | B2 | 12/2006 | Goshom et al. |
| 7,267,973 | B2 | 9/2007 | Backer et al. |
| 7,527,787 | B2 | 5/2009 | Chang et al. |
| 7,700,557 | B2 | 4/2010 | Backer et al. |
| 7,713,915 | B1 | 5/2010 | Gariepy et al. |
| 7,799,900 | B2 | 9/2010 | Adams |
| 7,834,258 | B2 | 11/2010 | Choe et al. |
| 7,887,801 | B2 | 2/2011 | Wels et al. |
| 8,048,985 | B2 | 11/2011 | Harrison et al. |
| 8,147,832 | B2 | 4/2012 | Carr et al. |
| 8,337,844 | B2 | 12/2012 | Carr et al. |
| 8,470,314 | B2 | 6/2013 | Davis et al. |
| 8,530,637 | B2 | 9/2013 | Wels et al. |
| 8,865,866 | B2 | 10/2014 | Harrison et al. |
| 8,895,006 | B2 | 11/2014 | Turner et al. |
| 8,969,529 | B2 | 3/2015 | O'Brien et al. |

(Continued)

FOREIGN PATENT DOCUMENTS

| | | | |
|---|---|---|---|
| AU | 750367 | B2 | 7/2002 |
| CN | 1272882 | A | 11/2000 |

(Continued)

OTHER PUBLICATIONS

Edelman et al. 2001 (Degeneracy and complexity in biological systems; PNAS 98(24): 13763-13768). (Year: 2001).*

Amino Acids; https://www.promega.com/-/media/files/resources/technical-references/amino-acid-abbreviations-and-molecular-weights.pdf; retrieved on Feb. 26, 2018, 1 page.

UniProtKB/Swiss-Prot P09385 (STXA_BP933), Shiga-like toxin 2 subunit A, retrieved from https://www.ncbi.nlm.nih.gov/protein/P09385.2 on Jan. 10, 2018, 7 pages.

Aatsinki, J. T. et al., "An alternative use of basic pGEX vectors for producing both N- and C-terminal fusion proteins for production and affinity purification of antibodies," Protein Expression and Purification, 40(2):287-291 (2005).

(Continued)

*Primary Examiner* — Mary Maille Lyons

(74) *Attorney, Agent, or Firm* — Cooley LLP

(57) ABSTRACT

The present invention provides cell-targeting molecules which can deliver a CD8+ T-cell epitope cargo to the MHC class I presentation pathway of a target cell. The cell-targeting molecules of the invention can be used to deliver virtually any CD8+ T-cell epitope from an extracellular space to the MHC class I pathway of a target cell, which may be a malignant cell and/or non-immune cell. The target cell can then display on a cell-surface the delivered CD8+ T-cell epitope complexed with MHC I molecule. The cell-targeting molecules of the invention have uses which include the targeted labeling and/or killing of specific cell-types within a mixture of cell-types, including within a chordate, as well as the stimulation of beneficial immune responses. The cell-targeting molecules of the invention have uses, e.g., in the treatment of a variety of diseases, disorders, and conditions, including cancers, tumors, growth abnormalities, immune disorders, and microbial infections.

15 Claims, 18 Drawing Sheets

Specification includes a Sequence Listing.

(56) References Cited

U.S. PATENT DOCUMENTS

| | | | |
|---|---|---|---|
| 9,175,059 B2 | 11/2015 | Pieczykolan et al. | |
| 9,364,557 B2 | 6/2016 | Neville, Jr. et al. | |
| 10,421,958 B2 | 9/2019 | Poma et al. | |
| 10,815,469 B2 | 10/2020 | Poma et al. | |
| 11,136,395 B2 * | 10/2021 | Poma | C07K 14/25 |
| 2002/0012658 A1 | 1/2002 | Williams et al. | |
| 2002/0168370 A1 | 11/2002 | McDonald et al. | |
| 2003/0166196 A1 | 9/2003 | Better et al. | |
| 2004/0141982 A1 | 7/2004 | Lust et al. | |
| 2004/0166565 A1 | 8/2004 | Backer et al. | |
| 2005/0054835 A1 | 3/2005 | Better et al. | |
| 2005/0069545 A1 | 3/2005 | Carr et al. | |
| 2009/0023649 A1 | 1/2009 | Backer et al. | |
| 2009/0092578 A1 | 4/2009 | Su et al. | |
| 2009/0156417 A1 | 6/2009 | Gariepy et al. | |
| 2009/0156502 A1 | 6/2009 | Harrison et al. | |
| 2010/0093563 A1 | 4/2010 | Williamson et al. | |
| 2010/0285004 A1 | 11/2010 | Tesar et al. | |
| 2011/0189209 A1 | 8/2011 | Neville, Jr. et al. | |
| 2012/0039908 A1 | 2/2012 | Combs et al. | |
| 2012/0149650 A1 | 6/2012 | Harrison et al. | |
| 2012/0251542 A1 | 10/2012 | Turner et al. | |
| 2012/0258104 A1 | 10/2012 | Echeverri | |
| 2013/0071325 A1 | 3/2013 | Sahin et al. | |
| 2013/0189271 A1 | 7/2013 | De Goeij et al. | |
| 2013/0196928 A1 | 8/2013 | Gariepy et al. | |
| 2014/0030273 A1 | 1/2014 | Verploegen et al. | |
| 2015/0044210 A1 | 2/2015 | Mechaly et al. | |
| 2015/0259428 A1 | 9/2015 | Poma et al. | |
| 2016/0017047 A1 | 1/2016 | Poma et al. | |
| 2016/0017784 A1 | 1/2016 | Kumar | |
| 2016/0068577 A1 | 1/2016 | Poma et al. | |
| 2016/0130362 A1 | 5/2016 | De Weers | |
| 2016/0177284 A1 | 6/2016 | Poma et al. | |
| 2016/0340394 A1 | 11/2016 | Poma et al. | |
| 2016/0347798 A1 | 12/2016 | Poma et al. | |
| 2016/0376328 A1 | 12/2016 | Poma et al. | |
| 2017/0002016 A1 | 1/2017 | Shishido et al. | |
| 2017/0002046 A1 | 1/2017 | Poma et al. | |
| 2017/0143814 A1 | 5/2017 | Poma et al. | |
| 2017/0275382 A1 | 9/2017 | Poma et al. | |
| 2018/0057544 A1 | 3/2018 | Poma et al. | |
| 2018/0243432 A1 | 8/2018 | Poma et al. | |
| 2018/0258143 A1 | 9/2018 | Poma et al. | |
| 2018/0258144 A1 | 9/2018 | Poma et al. | |
| 2018/0291359 A1 | 10/2018 | Poma et al. | |
| 2019/0083644 A1 | 3/2019 | Yoo et al. | |
| 2019/0100597 A1 | 4/2019 | Keyt et al. | |
| 2019/0153044 A1 | 5/2019 | Poma et al. | |
| 2019/0153471 A1 | 5/2019 | Paul et al. | |
| 2019/0249145 A1 | 8/2019 | Jang et al. | |
| 2019/0382755 A1 | 12/2019 | Poma et al. | |
| 2020/0002387 A1 | 1/2020 | Poma et al. | |
| 2020/0024312 A1 | 1/2020 | Poma et al. | |
| 2021/0008208 A1 | 1/2021 | Poma et al. | |
| 2021/0017512 A1 | 1/2021 | Poma et al. | |
| 2021/0253648 A1 | 8/2021 | Poma et al. | |
| 2021/0253649 A1 | 8/2021 | Poma et al. | |

FOREIGN PATENT DOCUMENTS

| | | |
|---|---|---|
| CN | 105713087 | 6/2016 |
| EP | 1 654 287 A2 | 8/2010 |
| EP | 2 778 173 A1 | 9/2014 |
| EP | 3 265 575 A2 | 1/2018 |
| EP | 3 448 874 A1 | 3/2019 |
| GB | 2 519 786 A | 5/2015 |
| JP | 1993-502880 A | 5/1993 |
| JP | 2011-507389 A | 6/1999 |
| JP | 2001-500730 A | 1/2001 |
| JP | 2002-521019 A | 7/2002 |
| JP | 2002-544173 A | 12/2002 |
| JP | 2003-531588 A | 10/2003 |
| JP | 2004-536778 A | 12/2004 |
| JP | 2006-502699 A | 1/2006 |
| JP | 2006-513691 A | 4/2006 |
| JP | 2007-536905 A | 12/2007 |
| JP | 2008-533977 A | 8/2008 |
| JP | 2009-502936 A | 1/2009 |
| JP | 2009-530468 A | 8/2009 |
| JP | 2011-050388 A | 3/2011 |
| JP | 2012-044997 A | 3/2012 |
| JP | 2012-070737 A | 4/2012 |
| JP | 2012-515551 A | 7/2012 |
| JP | 2014-515921 A | 7/2014 |
| KR | 2011-0033233 A | 3/2011 |
| KR | 2011-0119725 A | 11/2011 |
| WO | WO 91/009871 A1 | 7/1991 |
| WO | WO 94/26910 A1 | 11/1994 |
| WO | WO 96/30043 A1 | 10/1996 |
| WO | WO 96/040200 A1 | 12/1996 |
| WO | WO 98/11229 A3 | 3/1998 |
| WO | WO 99/40185 A1 | 8/1999 |
| WO | WO 00/04926 A2 | 2/2000 |
| WO | WO 00/67795 A1 | 11/2000 |
| WO | WO 01/70945 A1 | 9/2001 |
| WO | WO 01/77342 A1 | 10/2001 |
| WO | WO 02/40506 A2 | 5/2002 |
| WO | WO 03/066854 A1 | 8/2003 |
| WO | WO 03/072746 A2 | 9/2003 |
| WO | WO 03/074567 A2 | 9/2003 |
| WO | WO 2004/056312 A2 | 7/2004 |
| WO | WO 2004/058158 A2 | 7/2004 |
| WO | WO 2005/000902 A1 | 1/2005 |
| WO | WO 2005/016969 A2 | 2/2005 |
| WO | WO 2005/017148 A1 | 2/2005 |
| WO | WO 2005/052006 A2 | 6/2005 |
| WO | WO 2005/052129 A2 | 6/2005 |
| WO | WO 2005/092917 A1 | 10/2005 |
| WO | WO 2006/099875 A1 | 9/2006 |
| WO | WO 2007/005874 A2 | 1/2007 |
| WO | WO 2007/014238 A2 | 2/2007 |
| WO | WO 2007/033497 A1 | 3/2007 |
| WO | WO 2007/071061 A1 | 6/2007 |
| WO | WO 2007/098201 A2 | 8/2007 |
| WO | WO 2007/107779 A1 | 9/2007 |
| WO | WO 2008/080218 A1 | 7/2008 |
| WO | WO 2009/014835 A2 | 1/2009 |
| WO | WO 2009/017823 A2 | 2/2009 |
| WO | WO 2009/032954 A1 | 3/2009 |
| WO | WO 2009/064815 A1 | 5/2009 |
| WO | WO 2009/088403 A2 | 7/2009 |
| WO | WO 2009/110944 A1 | 9/2009 |
| WO | WO 2010/011697 A1 | 1/2010 |
| WO | WO 2010/085539 A1 | 7/2010 |
| WO | WO 2011/009624 A1 | 1/2011 |
| WO | WO 2012/022985 A1 | 2/2012 |
| WO | WO 2012/093158 A1 | 7/2012 |
| WO | WO 2012/101235 A1 | 8/2012 |
| WO | WO 2012/104344 A1 | 8/2012 |
| WO | WO 2012/154530 A1 | 11/2012 |
| WO | WO 2013/080147 A2 | 6/2013 |
| WO | WO 2014/086952 A1 | 6/2014 |
| WO | WO 2014/164680 A1 | 10/2014 |
| WO | WO 2014/164693 A2 | 10/2014 |
| WO | WO 2015/063187 A1 | 5/2015 |
| WO | WO 2015/113005 A1 | 7/2015 |
| WO | WO 2015/113007 A1 | 7/2015 |
| WO | WO 2015/120058 A2 | 8/2015 |
| WO | WO 2015/138435 A1 | 9/2015 |
| WO | WO 2015/138452 A1 | 9/2015 |
| WO | WO 2015/191764 A1 | 12/2015 |
| WO | WO 2015/191883 A1 | 12/2015 |
| WO | WO 2015/193411 A1 | 12/2015 |
| WO | WO 2016/126950 A1 | 8/2016 |
| WO | WO 2016/196344 A1 | 12/2016 |
| WO | WO 2017/019623 A2 | 2/2017 |
| WO | WO 2018/080812 A1 | 5/2018 |
| WO | WO 2018/106895 A1 | 6/2018 |
| WO | WO 2018/140427 A1 | 8/2018 |
| WO | WO 2018/159615 A1 | 9/2018 |
| WO | WO 2018/162749 A1 | 9/2018 |

(56) References Cited

FOREIGN PATENT DOCUMENTS

| WO | WO 2019/059400 A1 | 3/2019 |
|---|---|---|
| WO | WO 2020/081493 A1 | 4/2020 |
| WO | WO 2020/154475 A1 | 7/2020 |

OTHER PUBLICATIONS

Ackerman, R. et al., "SLT-VEGF Reduces Lung Metastases, Decreases Tumor Recurrence, and Improves Survival in an Orthotropic Melanoma Model," Toxins (Basel), 2(9):224-257 (2010).
Adotevi, O. et al., "B Subunit of Shiga Toxin-Based Vaccines Synergize with α-Galactosylceramide to Break Tolerance against Self Antigen and Elicit Antiviral Immunity," The Journal of Immunology, 179(5):3371-3379 (2007).
Al-Jaufy, A. Y. et al., "Cytotoxicity of a Shiga toxin A Subunit-CD4 Fusion Protein to Human Immunodeficiency Virus-Infected Cells," Infection and Immunity, 62(3):956-960 (1994).
Al-Jaufy, A. Y. et al., "Purification and Characterization of a Shiga-Toxin A Subunit-CD4 Fusion Protein Cytotoxic to Human Immunodeficiency Virus-Infected Cells," Infection and Immunity, 63(8):3073-3078 (1995).
Antignani, A. & Fitzgerald, D., "Immunotoxins: The Role of the Toxin," Toxins, 5(8): 1486-1502 (2013).
Apostolpoulos, V. et al., "MUC1 peptide epitopes associated with five different H-2 class I molecules," European Journal of Immunology, 27(10):2579-2587 (1997).
Backer, M. V. et al., "Shiga-like toxin-VEGF fusion proteins are selectively cytotoxic to endothelial cells overexpressing VEGFR-2," Journal of Controlled Release, 74(1-3):349-355 (2001).
Backer, M. V. & Backer, J. M., "Targeting Endothelial Cells Overexpressing VEGFR-2: Selective Toxicity of Shiga-like Toxin-VEGF Fusion Proteins," Bioconjugate Chemistry, 12(6): 1066-1073 (2001).
Baker, M. P. et al., "Immunogenicity of Protein Therapeutics: the Key Causes, Consequences and Challenges," Self/Nonself, 1(4):314-322 (2010).
Ballard, J. D. et al., "Anthrax Toxin-Mediated Delivery In Vivo and In Vitro of a Cytotoxic T-Lymphocyte Epitope from Ovalbumin," Infection and Immunity, 66(2):615-619 (1998).
Ballard, J. D. et al., "Anthrax Toxin as a Molecular Tool for Stimulation of Cytotoxic T Lymphocytes: Disulfide-Linked Epitopes, Multiple Injections, and Role of CD4+Cells," Infection and Immunity, 66(10):4696-4699 (1998).
Barnd, D. L. et al., "Specific, Major Histocompatibility Complex-Unrestricted Recognition of Tumor-Associated Mucins by Human Cytotoxic T cells," Proceedings of the National Academy of Sciences U.S.A., 86(18):7159-7163 (1989).
Barratt-Boyes, S. M. et al., "Immunization of Chimpanzees with Tumor Antigen MUC1 Mucin Tandem Repeat Peptide Elicits Both Helper and Cytotoxic T-cell Responses," Clinical Cancer Research, 5(7):1918-1924 (1999).
Beers, S. A. et al., "Type II (tositumomab) anti-CD20 monoclonal antibody out performs type I (rituximablike) reagents in B-cell depletion regardless of complement activation," Blood, 112:4170-4177 (2008).
Beers, S. A. et al., "CD20 as a Target for Therapeutic type I and II Monoclonal Antibodies," Seminars in Hematology, 47(2):107-114 (2010).
Beers, S. A. et al., "Antigenic modulation limits the efficacy of anti-CD20 antibodies: implications for antibody selection," Blood, 115(25):5191-5201 (2010).
Bera, T. K. et al., "A Bivalent Disulfide-stabilized Fv with Improved Antigen Binding to erbB2," Journal of Molecular Biology, 281(3):475-483 (1998).
Bera, T. K. et al., "Pharmacokinetics and Antitumor Activity of a Bivalent Disulfide-stabilized Fv Immunotoxin with Improved Antigen Binding to erbB2," Cancer Research, 59(16):4018-4022 (1999).
Beum, P. V. et al., "The Shaving Reaction: Rituximab/CD20 Complexes Are Removed from Mantle Cell Lymphoma and Chronic Lymphocytic Leukemia Cells by THP-1 Monocytes," The Journal of Immunology, 176(4):2600-2609 (2006).
Beum, P. V. et al., "Loss of CD20 and Bound CD20 Antibody from Opsonized B Cells Occurs More Rapidly Because of Trogocytosis Mediated by Fc Receptor-Expressing Effector Cells than Direct Internalization by the B Cells," The Journal of Immunology, 187(6):3438-3447 (2011).
Bevan et al. "Real-time 96-well antibody internalization assays using IncuCyte FabFluor Red Antibody Labeling Reagent, Application Note, Sartorious", Essen BioScience (2017).
Bibby, M. C., "Orthotopic models of cancer for preclinical drug evaluation: advantages and disadvantages," European Journal of Cancer, 40(6):852-857 (2004).
Boes, A. et al., "Affinity Purification of a Framework 1 Engineered Mouse/Human Chimeric IgA2 Antibody From Tobacco," Biotechnology Bioengineering, 108(12):2804-2814 (2011).
Böldicke, T., "Blocking translocation of cell surface molecules from the ER to the cell surface by intracellular antibodies targeted to the ER," J. Cell. Mol., 11(1):54-70 (2007).
Bolognesi, A. et al., "A comparison of anti-lymphocyte immunotoxins containing different ribosome-inactivating proteins and antibodies," Clinical & Experimental Immunology, 89(3):341-346 (1992).
Bonifaz, L. et al., "Efficient targeting of protein antigen to the dendritic cell receptor DEC-205 in the steady state leads to antigen presentation on major histocompatibility complex class I products and peripheral CD8+ T cell tolerance," Journal of Experimental Medicine, 196(12):1627-1638 (2002).
Boross, P. et al., "Both activating and inhibitory Fc gamma receptors mediate rituximab-induced trogocytosis of CD20 in mice," Immunology Letters, 143(1):44-52 (2012).
Boross, P. et al., "Mechanisms of action of CD20 antibodies," American Journal of Cancer Research, 2(6):676-690 (2012).
Braslawsky, G. R. et al., "Adriamycin(hydrazone)-antibody conjugates require internalization and intracellular acid hydrolysis for antitumor activity," Cancer Immunology, Immunotherapy, 33:367-374 (1991).
Bray, M. R. et al., "Probing the surface of eukaryotic cells using combinatorial toxin libraries," Current Biology, 11(9):697-701 (2001).
Brieschke, B. et al., "Targeted Engineered Toxin Bodies provide a novel mechanism of action against HER2 positive cancers," Cancer Research, 78 (13 Suppl), (Jul. 2018), Abstract 5769.
Brieschke, B. et al., "Targeted Engineered Toxin Bodies provide a novel mechanism of action against HER2 positive cancers," Proceedings: American Association for Cancer Research (AACR) Annual Meeting 2018, (Apr. 18, 2018).
Brieschke, B. et al., "Identification and Functional Profiling of PD-L1 Targeted Engineered Toxin Bodies for Antigen Seeding Technology (AST) and Redirection of T cell Response to Tumors," 33rd Annual Meeting of the Society for Immunotherapy of Cancer (SITC), Washington, D.C., Poster # 11078, (Nov. 7-11, 2018).
Brieschke, B. et al., "Identification and functional profiling of PD-L1 targeted engineered toxin bodies for antigen seeding technology and redirection of T cell response to tumors," Journal of ImmunoTherapy of Cancer, 6(Suppl 1): 114, (Nov. 6, 2018), Abstract P9.
Brieschke, B. et al., "P9 Identification and functional profiling of PD-L1 targeted engineered toxin bodies for antigen seeding technology and redirection of T cell response to tumors," Journal for Immunotherapy of Cancer, 6(S1):p. 5 (2018).
Brieschke, B. et al., "Antigen Seeding Technology by engineered Toxin bodies Provides a Targeted Immuno-Oncology Approach for Treatment of Cancers," Proceedings: American Association for Cancer Research (AACR) Annual Meeting 2018, Poster 2777, Abstract #4912 (Apr. 14-18, 2018).
Brigotti, M. et al., "Damage to Nuclear DNA Induced by Shiga Toxin 1 and Ricin in Human Endothelial Cells," The FASEB Journal, 16(3):365-372 (2002).
Brigotti, M. et al., "Change in Conformation with Reduction of α-Helix Content Causes Loss of Neutrophil Binding Activity in Fully Cytotoxic Shiga toxin 1," The Journal of Biological Chemistry, 286(40):34514-34521 (2011).

(56) References Cited

OTHER PUBLICATIONS

Bujny, M. V. et al., "The retromer component sorting nexin-1 is required for efficient retrograde transport of Shiga toxin from early endosome to the trans Golgi network," Journal of Cell Science, 120(Pt 12):2010-2021 (2007).
Burgess, B. J. et al., "Proteolytic cleavage at arginine residues within the hydrophilic disulphide loop of the *Escherichia coli* Shiga-like toxin I A subunit is not essential for cytotoxicity," Molecular Microbiology, 10(1):171-179 (1993).
Cao, C. et al., "Construction of mutant genes for a non-toxic verotoxin 2 variant (VT2vp1) of *Escherichia coli* and characterization of purified mutant toxins," Microbiology and Immunology, 38(6):441-447 (1994).
Cao, Y. et al., "Design optimization and characterization of Her2/neu-targeted immunotoxins: comparative in vitro and in vivo efficacy studies," Oncogene, 33(4): 1-11 (2013).
Cao, Y. et al., "Construction and characterization of novel, recombinant immunotoxins targeting the Her2/neu oncogene product: in vitro and in vivo studies," Cancer Research, 69(23): 8987-8995 (2009).
Carbonetti, N. H. et al., "Intracellular Delivery of a Cytolytic T-Lymphocyte Epitope Peptide by Pertussis Toxin to Major Histocompatibility Complex Class I without Involvement of the Cytosolic Class I Antigen Processing Pathway," Infection and Immunity, 67(2):602-607 (1999).
Carbonetti, N. H. et al., "Stimulation of HIV gp120-specific cytolytic T lymphocyte responses in vitro and in vivo using a detoxified pertussis toxin vector," AIDS Research and Human Retroviruses, 17(9): 819-827 (2001).
Carbonetti, N. H., "Pertussis toxin and adenylate cyclase toxin: key virulence factors of Bordetella pertussis and cell biology tools," Future Microbiology, 5:455-469 (2010).
Casalini, P. et al., "Use of combination of Monoclonal Antibodies Directed Against three distinct epitopes of a Tumor-Associated Antigen: Analysis of Cell-Binding and Internalization," International Journal of Cancer, 48:2 284-290 (1991).
Casset, F. et al., "A peptide mimetic of an anti-CD4 monoclonal antibody by rational design," Biochemical and Biophysical Research Communications, 307(1): 198-205 (2003).
Chatterjee, S. et al., "Noninvasive Imaging of Immune Checkpoint Ligand PD-L1 in Tumors and Metastases for Guiding Immunotherapy," Molecular Imaging, 16:1-5 (2017).
Cheung, M. C. et al., "An evolved ri bo-in activating protein targets and kills human melanoma cells in vitro and in vivo," Molecular Cancer, 9(28): 1-14 (2010).
Cheung, M. C. et al., "A Ribosome-inactivating Protein Toxin as a Template for Cancer Drug Discovery", thesis, University of Toronto, (2012), retrieved from http://hdl.handle.net/1807/33952, 202 pages.
Cizeau, J. P. A. et al., "DeBouganin: A de-immunized toxin payload and its applications in oncology," 8th Fabisch-Symposium, 3rd Targeted Tumor Therapies, Berlin 2012, Mar. 21, 2012.
Cizeau, J. et al., "Fusogenics: A Recombinant Immunotoxin-Based Screening Platform to Select Internalizing Tumor-Specific Antibody Fragments," Journal of Biomolecular Screening 16(1):90-100 (2011).
Cleton-Jansen, A. et al., "A Single Amino Acid Substitution Changes the Substrate Specificity of Quinoprotein Glucose Dehydrogenase in Gluconobacteroxydans," Molecular and General Genetics, 229(2):206-212 (1991).
Cragg, M. S. et al., "Apparent modulation of CD20 by rituximab: an alternative explanation," Blood, 103(10):3889-3990 (2004).
Cuesta, A. M. et al., "Mutivalent antibodies: when design surpasses evolution," Trends in Biotechnology, 28(7):355-362 (2010).
Dadaglio, G, et al., "Induction of a Polarized Th1 Response by Insertion of Multiple Copies of a Viral T-Cell Epitope into Adenylate Cyclase of Bordetella pertussis," Infection and Immunity, 68(7):3867-3872 (2000).
Dadaglio, G, et al., "Recombinant adenylate cyclase toxin of Bordetella pertussis induces cytotoxic T lymphocyte responses against HLA*0201-restricted melanoma epitopes," International Immunology, 15(12):1423-1430 (2003).
De Pascalis, R. et al., "Grafting of "abbreviated" complementarity-determining regions containing specificity-determining residues essential for ligand contact to engineer a less immunogenic humanized monoclonal antibody," The Journal of Immunology, 169(6):3076-3084 (2002).
Dekker et al., "Engineered Toxin Bodies delivering immunogenic MHC class I peptides to tumor cells summon polyfunctional and relevant CTL responses against cancers," Presented at: IMMUNOLOGY 2019™, Annual Meeting of the American Association of Immunologists, May 10, 2019, The American Association of Immunologists, Inc., San Diego, Abstract 1791.
Dekker, J. D. et al., Abstract 1791, "Engineered toxin bodies delivering immunogenic MHC class I peptides to tumor cells summon polyfunctional and relevant CTL responses against cancers," Molecular Templates, AAI 2019, Poster, 2 pages.
Deresiewicz, R. L. et al., "Mutations Affecting the Activity of the Shiga-like Toxin I A-Chain," Biochemistry, 31(12):3272-3280 (1992).
Deresiewicz, R. L. et al., "The role of tyrosine-114 in the enzymatic activity of the Shiga-like toxin I A-chain," Mol. Gen. Genet., 241:467-473 (1993).
Déret, S. et al., "SUBIM: a program for analysing the Kabat database and determining the variability subgroup of a new immunoglobulin sequence," CABIOS, 11(4):435-439 (1995).
Dermer, G. B., "Another Anniversary for the War on Cancer," Bio/Technology 12:320 (1994).
Di, R. et al., "Identification of amino acids critical for the cytotoxicity of Shiga toxin 1 and 2 in *Saccharomyces cerevisiae,*" Toxicon, 57(4):525-539 (2011).
Doling, A. M. et al., "Cytotoxic T-Lymphocyte Epitopes Fused to Anthrax toxin Induce protective Antiviral Immunity," Infection and Immunity, 67(7):3290-3296 (1999).
Donnelly, J. J. et al., "Targeted delivery of peptide epitopes to class I major histocompatibility molecules by a modified Pseudomonas exotoxin," Proceedings of the National Academy of Sciences U.S.A., 90:3530-3534 (1993).
Engedal, N. et al., "Shiga toxin and its use in targeted cancer therapy and imaging," Microbiology Biotechnology, 4(1):32-46 (2011).
Eriksson, K. et al., "Coupling of antigen to cholera toxin for dendritic cell vaccination promotes the induction of MHC class I-restricted cytotoxic T cells and the rejection of a cognate antigen-expressing model tumor," European Journal of Immunology, 34(5): 1272-1281 (2004).
Ewers, H. & Helenius, A., "Lipid-Mediated Endocytosis," Cold Spring Harbor Perspectives in Biology, 3(8):1-14 (2011).
Fanale, M. A. et al., "Phase I/Ib study of the novel CD20-targeted immunotoxin MT-3724 in relapsed/refractory non-Hodgkin's B-cell lymphoma," Proceedings of the 107th Annual Meeting of the American Association for Cancer Research (AACR), Abstract # CT049, (Apr. 16-20, 2016), 2 pages.
Fanale, M. A. et al., "Phase I/Ib study of the novel CD20-targeted immunotoxin MT-3724 in relapsed/refractory non-Hodgkin's B-cell lymphoma," Cancer Research, 76(14 Suppl), (Jul. 2016), Abstract nr CT049.
Fayolle, C. et al., "Delivery of Multiple Epitopes by Recombinant Detoxified Adenylate Cyclase of Bordetella pertussis Induces Protective Antiviral Immunity," Journal of Virology, 75(16):7330-7338 (2001).
Fayolle, C, et al., "Therapy of Murine Tumors with Recombinant Bordetella pertussis Adenylate Cyclase Carrying a Cytotoxic T Cell Epitope," The Journal of Immunology, 162(7): 4157-4162 (1999).
Filpula, D., "Releasable PEGylation of Mesothelin Targeted Immunotoxin SSIP Achieves Single Dosage Complete Regression of a Human Carcinoma in Mice," Bioconjugate Chemistry, 18(3):773-784 (2007).
Freshney, R.I., "Culture of Animal Cells: A Manual of Basic Technique," Alan R. Liss, Inc., 1983, New York, pp. 3-4.
Gannon, V. P. et al., "Molecular cloning and nucleotide sequence of another variant of the *Escherichia coli* Shiga-like toxin II family," Journal of General Microbiology, 136(6):1125-1135 (1990).
Garred, O. et al., "Role of processing and intracellular transport for optimal toxicity of Shiga toxin and toxin mutants," Experimental Cell Research, 218(1):39-49 (1995).

(56) References Cited

OTHER PUBLICATIONS

Garred, O. et al., "Furin-induced cleavage and activation of Shiga toxin," Journal of Biological Chemistry, 270(18):10817-10821 (1995).
Gavrilov, B. K. et al., "Effects of Glycosylation on Antigenicity and Immunogenicity of Classical Swine Fever Virus Envelope Proteins," Virology, 420(2):135-145 (2011).
Gendler, S. et al., "A Highly Immunogenic Region of a Human Polymorphic Epithelial Mucin Expressed by Carcinomas Is Made Up of Tandem Repeats," Journal of Biological Chemistry, 263(26):12820-12823 (1988).
Ghetie, M. A. et al., "Homodimers but not monomers of Rituxan (chimeric anti-CD20) induce apoptosis in human B-lymphoma cells and synergize with a chemotherapeutic agent and an immunotoxin," Blood, 97(5):1392-1398 (2001).
Giansanti, F. et al., "Strategies to Improve the Clinical Utility of Saporin-Based Targeted Toxins," Toxins, 10(82): 1-32 (2018).
Glelis, S. et al., "Detection of Enriched T Cell Epitope Specificity in Full T Cell Receptor Sequence Repertoires," Frontiers in Immunology, vol. 10, Article 2820, pp. 1-13 2019).
Gilliland, D. G. et al., "Antibody-directed cytotoxic agents: use of monoclonal antibody to direct the action of toxin A chains to colorectal carcinoma cells," Proceedings of the National Academy of Sciences of the United States of America, 77(8):4539-43 (1980).
Glennie, M. J. et al., "Mechanisms of killing by anti-CD20 monoclonal antibodies," Molecular Immunology, 44(16):3823-3837 (2007).
Gong, J. et al., "Selection and characterization of MUC1-specific CD8+ T cells from MUC1 transgenic mice immunized with dendritic-carcinoma fusion cells," Immunology, 101(3):316-324 (2000).
Gordon, V. M. et al., "An enzymatic Mutant of Shiga-like Toxin II Variant is a vaccine Candidate for Edema Disease of Swine," Infection and Immunity, 60(2):485-490 (1992).
Goulet, A. C. et al.,"Conjugation of Blocked Ricin to an Anti-CD19 Monoclonal Antibody Increases Antibody-Induced cell Calcium Mobilization and CD19 Internalization," Blood 90(6): 2364-2375 (1995).
Grant, K. et al., "Abstract 1380: Engineered toxin bodies with specific activity against EGFR and HER2 expressing cells," Proceedings of the 102nd Annual Meeting of the American Association for Cancer Research (AACR); Apr. 2-6, 2011; The Journal of Cancer Research, 71 (8 Suppl): Abstract #1380, (Apr. 2011).
Grotzke, J. E. et al., "The ongoing saga of the mechanism(s) of MHC class I-restricted cross-presentation," Current Opinion in Immunology, 46:89-96 (2017).
Guermonprez, P. et al., "Les Toxines Bacteriennes Recombinantes: De Nouveaux Vecteurs Pour La Vaccination?" M/S Medicine Sciences, Societe Des Periodiques Flammarion, 16(5):653-662 (2000).
Guermonprez, P. et al., "The Adenylate Cyclase Toxin of *Bordetella pertussis* Binds to Target Cells via the αMβ2 Integrin (CD11b/CD18)," Journal of Experimental Medicine, 193(9):1035-1044 (2001).
Güssow, D. & Seeman, G., "Humanization of Monoclonal Antibodies," Methods in Enzymology, 203:99-121 (1991).
Haddad, J. E. et al., "Minimum Domain of the Shiga Toxin A subunit Required for Enzymatic Activity," Journal of Bacteriology, 175(16):4970-4978 (1993).
Haicheur, N. et al., "The B Subunit of Shiga Toxin Fused to a Tumor Antigen Elicits CTL and Targets Dendritic Cells to Allow MHC Class I-Restricted Presentation of Peptides Derived from Exogenous Antigens," The Journal of Immunology, 165(6):3301-3308 (2000).
Haisma, H. J. et al., "Construction and Characterization of a Fusion Protein Single-Chain Anti-CD20 Antibody and Human beta-glucuronidase for Antibody-Directed Enzyme Prodrug Therapy," Blood, 92(1): 184-190 (1998).
Hamlin, P. A. et al., "Safety and Efficacy of Anti-CD20 Immunotoxin MT-3724 in Relapsed/refractory B-cell Non-Hodgkin Lymphoma (NHL) in a Phase 1 study," American Society of Clinical Oncology Annual Meeting—Abstract 7580 (2018).
Harris, B., "Exploiting antibody-based technologies to manage environmental pollution," Trends in Biotechnology, DIAGRAM figure taken from 17(7):290-296 (1999).
Harwerth, I. M. et al., Monoclonal Antibodies against the Extracellular Domain of the erbB-2 Receptor Function as Partial Ligand Agonists, Journal of Biol. Chem, 267(21): 15160-15167 (1992).
Head, S. C. et al., "Preparation of VT1 and VT2 hybrid toxins from their purified dissociated subunits. Evidence for B subunit modulation of a subunit function," Journal of Biological Chemistry, 266(6):3617-3621 (1991).
Hegde, N. R. et al., "The use of databases, data mining and immunoinformatics in vaccinology: where are we?" Expert Opinion on Drug Discovery, 13(2): 117-130 (2018).
Hexham, J. M. et al., "Influence of relative binding affinity on efficacy in a panel of anti-CD3 scFv immunotoxins," Molecular Immunology, 38(5):397-408 (2001).
Higgins, J. P. et al., "Engineered toxin bodies with specific cell kill activity against mesenchymal cells," Cancer Research, 71(8 Suppl) (Apr. 2011), Abstract #1751.
Hiraga, J. et al., "Down-regulation of CD20 expression in B-cell lymphoma cells after treatment with rituximab-containing combination chemotherapies: its prevalence and clinical significance," Blood, 113(20):4885-4893 (2009).
Holubova, J. et al., "Delivery of Large Heterologous Polypeptides across the Cytoplasmic Membrane of Antigen-Presenting Cells by the Bordetella RTX Hemolysin Moiety Lacking the Adenylyl Cyclase Domain," Infection and Immunity, 80(3):1181-1192 (2012).
Hooijberg et al., "Characterization of a series of isotype switch variants of new CD20 monoclonal antibody," Hybridoma, 15(1):23-31 (1996).
Hotz, B. et al., "Specific Targeting of Tumor Endothelial Cells by a Shiga-like Toxin-Vascular Endothelial Growth Factor Fusion Protein as a Novel Treatment Strategy for Pancreatic Cancer," Neoplasia, 12(10):797-806 (2010).
Hovde, C. J. et al.,"Evidence that glutamic acid 167 is an active-site residue of Shiga-like toxin-I," Proceedings of the National Academy of Sciences of the United States of America, 85(8):2568-2572 (1988).
Huang, S. et al., "The CD20-specific engineered toxin antibody MT-3724 exhibits lethal effects against manmgle cell lymphoma," Blood Cancer Journal, 8(3):33 (2018).
Huang, S. et al. "Abstract 3651: Preclinical examination of the effects of MT-3724, an engineered toxin body targeting CD20, in mantle cell lymphoma," AACR Annual Meeting Abstract (2017).
Huang, S. et al. "AACR 2017 | Poster 3651/24—Preclinical examination of the effects of a CD20-specific engineered toxin body, MT-3724, in Mantle Cell Lymphoma," AACR Annual Meeting, Poster 3651/24 (2017).
Iberg, A. et al., "Design and Characterization of Bispecific Engineered Toxin Bodies for Targeted Cancer Therapy," Proceedings: American Association for Cancer Research (AACR) Annual Meeting 2019, Poster #2984 (2019).
Ishikawa, S. et al., "Protection against Shiga Toxin I Challenge by Immunization of Mice with Purified Mutant Shiga Toxin 1," Infection and Immunity, 71(6):3235-3239 (2003).
Jackson, R. L. et al., "Mutational analysis of the Shiga Toxin and Shiga-like toxin II enzymatic subunits," Journal of Bacteriology, 172(6):3346-3350 (1990).
Jackson, M. E. et al., "The KDEL retrieval system is exploited by Pseudomonas exotoxin A, but not by Shiga-like toxin-1, during retrograde transport from the Golgi complex to the endoplasmic reticulum," Journal of Cell Science, 112(4):467-475 (1999).
Jain, R. K., "Barriers to Drug Delivery in Solid Tumors," Scientific American, 271(1):58-65 (1994).
Jilani, I. et al., "Anti-Idiotype versus anti-mouse Ig for detecting ritumixab," Blood, 103(10):3990 (2004).
Jilani, I. et al., "Transient down-modulation of CD20 by ritumixab in patients with chronic lymphocytic leukemia," Blood , 102(10):3514-3520 (2003).
Johannes, L. et al., "Retrograde Transport of KDEL-bearing B-fragment of Shiga Toxin," Journal of Biological Chemistry, 272(31):19554-19561 (1997).
Johannes, L. et al., "Shiga toxins—from cell biology to biomedical applications," Nature Reviews Microbiology, 8(2):105-116 (2010).
Johannes, L. & Decaudin, D., "Protein toxins: intracellular trafficking for targeted therapy," Gene Therapy, 12(18):1360-1368 (2005).

(56) References Cited

OTHER PUBLICATIONS

Johnson, N. et al., "Construction of an epitope vector utilizing the diphtheria toxin B-subunit," FEMS Microbiology Letters, 146(1):91-96 (1997).
Jones, D. T., "Critically Assessing the State-of-the-art in Protein Structure Prediction," The Pharmacogenomics Journal, 1(2):126-134 (2001).
Jubala, C. M. et al., "CD20 Expression in Normal Canine B cells and in Canine non-Hodgkin Lymphoma," Veterinary Pathology, 42(4):468-476 (2005).
Kar, P. et al., "Current methods for the prediction of T-cell epitopes," Peptide Science, 110:e24046 (2018), 17 pages; https://doi.org/10.1002/pep2.24046.
Karanikas, V. et al., "Antibody and T Cell Responses of Patients with Adenocarcinoma Immunized with Mannan-MUC1 Fusion Protein," Journal of Clinical Investigation, 100(11): 2783-2792 (1997).
Karimova, G. et al., "Charge-dependent translocation of *Bordetella pertussis* adenylate cyclase toxin into eukaryotic cells: Implication for the in vivo delivery of CD8+ T cell epitopes into antigen-presenting cells," Proc. Natl. Acad. Sci. USA, 95:12532-12537 (1998).
Kelland, L. R., "'Of mice and men': values and liabilities of the athymic nude mouse model in anticancer drug development," European Journal of Cancer, 40(6):827-836 (2004).
Kim, G. B. et al., "A fold-back single chain diabody format enhances the bioactivity of an anti-monkey CD3 recombinant diphtheria toxin-based immunotoxin," Protein Engineering, 20(9):425-432 (2007).
Kotera, Y. et al., "Humoral Immunity against a Tandem Repeat Epitope of Human Mucin MUC-1 in Sera from Breast, Pancreatic, and Colon Cancer Patients," Cancer Research 54(11):2856-2860 (1994).
Kowanetz, M. et al., "Differential regulation of PD-L1 expression by immune and tumor cells in NSCLC and the response to treatment with atezolizumab (anti-PD-L1)," PNAS, 115(43):e10119-e10126 (2018).
Kurmanova, A. et al., "Structural requirements for furin-induced cleavage and activation of Shiga toxin," Biochemical and Biophysical Research Communications, 357(1):144-149 (2007).
Kyu, E., "Characterization of the A subunit mutants of Stx1 and Stx2 in *Saccharomyces cerevisiae*," Thesis, Rutgers, The State University of New Jersey, New Brunswick, retrieved from http://dx.doi.org/doi:10.7282/T34F1QWJ (2009), 57 pages.
Lakhrif, Z. et al., "A method to confer protein L binding ability to any antibody fragment," MAbs, 8(2):379-388 (2016).
Lambert, J. et al., "Purified Immunotoxins that are reactive with Human Lymphoid Cells: Monoclonal antibodies conjugated to the ribosome-inactivating proteins gelonin and the pokeweed antiviral proteins," Journal of Biological Chemistry, 260(22):12035-12041 (1985).
Lapointe, P. et al., "A Role for the Protease-sensitive Loop Region of Shiga-like Toxin 1 in the Retrotranslocation of its A Domain from the Endoplasmic Reticulum Lumen," Journal of Biological Chemistry, 280(24):23310-23318 (2005).
Laske, D. W. et al., "Intraventricular Immunotoxin Therapy for Leptomeningeal Neoplasia," Neurosurgery, 41(5):1039-1051 (1997).
Law, C. L. et al., "Efficient Elimination of B-Lineage Lymphomas by Anti-CD20-Auristatin Conjugates," Clinical Cancer Research, 10(23):7842-7851 (2004).
Lazar, E. et al., "Transforming Growth Factor alpha: Mutation of Aspartic Acid 47 and Leucine 48 Results in Different Biological Activities," Molecular and Cellular Biology, 8(3):247-1252 (1988).
Lea, N. et al., "Proteolytic cleavage of the A subunit is essential for maximal cytotoxicity of *Escherichia coli* O157:h7 Shiga-like toxin-1," Microbiology, 145(5):999-1004 (1999).
Lee, J. E. et al.."Phylogenetic analysis of Shiga toxin 1 and Shiga toxin 2 genes associated with disease outbreaks," BMC Microbiology, 7(1):109 (2007), 12 pages; doi.org/10.1186/1471-2180-7-109.
Lee, H. T. et al., "Molecular mechanism of PD-1/PD-L1 blockade via anti-PD-L1 antibodies atezolizumab and durvalumab," Scientific Reports, 7(1):5532 (2017), 12 pages; doi: 10.1038/s41598-017-06002-8.
Lee, R. S. et al., "Major histocompatibility complex class I presentation of exogenous soluble tumor antigen fused to the B-fragment of Shiga toxin," European Journal of Immunology, 28: 2726-2737 (1998).
Lehmann, C. H. K. et al., "Direct Delivery of Antigens to Dendritic Cells via Antibodies Specific for Endocytic Receptors as a Promising Strategy for Future Therapies," Vaccines, 4(2):1-32 (2016).
Lev, A. et al., "Tumor-specific Ab-mediated targeting of MHC-peptide complexes induces regression of human tumor xenografts in vivo," PNAS, 101 (24):9051-9056 (2004).
Li, H. et al., "The CD20 Calcium Channel is Localized to Microvilli and Constitutively Associated with Membrane Rafts: Antibody binding increases the affinity of the association through an epitope-dependent cross-linking-independent mechanism," Journal of Biological Chemistry, 279(19):19893-19901 (2004).
Li, B. et al., "Development of Novel Tetravalent Anti-CD20 Antibodies with Potent Antitumor Activity," Cancer Research, 68(7):2400-2408 (2008).
Li, M. et al., "Clinical targeting recombinant immunotoxins for cancer therapy," Onco Targets and Therapy, 10:3645-3665 (2017).
Li, Y. et al., "Correction to: Discovery and preclinical characterization of the antagonist anti-PD-L1 monoclonal antibody LY3300054," Journal for ImmunoTherapy of Cancer, vol. 6, No. 1, Jun. 2018, p. 1.
Lim, S. H. et al., "Fc gamma receptor IIb on target B cells promotes rituximab internalization and reduces clinical efficacy," Blood, 118(9):2530-2540 (2011).
Ling, H. et al., "Structure of the Shiga-like Toxin I B-Pentamer complexed with an Analogue of Its Receptor Gb3," Biochemistry, 37(7):1777-1788 (1998).
Luqman, M. et al., "The antileukemia activity of a human antiCD40 antagonist antibody, HCD122, on human chronic lymphocytic leukemia cells," Blood, 112(3):711-720 (2008).
Lyu, M.-A. et al., "Cell-targeting fusion constructs containing recombinant gelonin," Methods in Enzymology, 502:167-214 (2012).
Maak, M. et al., "Tumor-Specific Targeting of Pancreatic Cancer with Shiga Toxin B-Subunit," Molecular Cancer Therapeutics, 10(10):1918-1928 (2011).
Mallard, F. et al., "Direct Pathway from Early/Recycling Endosomes to the Golgi Apparatus Revealed through the Study of Shiga Toxin B-fragment Transport," The Journal of Cell Biology, 143(4):973-990 (1998).
Mascarell, L. et al., "Induction of Neutralizing Antibodies and Th1-Polarized and CD4-lndependent CD8+ T-Cell Responses following Delivery of Human Immunodeficiency Virus Type 1 Tat Protein by Recombinant Adenylate Cyclase of Bordetella pertussis," Journal of Virology, 79(15):9872-9884 (2005).
Mazor, Y. et al., "chFRP5-ZZ-PE38, a large IgG-toxin immunoconjugate outperforms the corresponding smaller FRP5(Fv)-ETA immunotoxin in eradicating ErbB2-expressing tumor xenografts," Cancer Letters, 257(1):124-135 (2007).
Mazor, R. et al., "Identification and elimination of an immunodominant T-cell epitope in recombinant immunotoxins based on Pseudomonas exotoxin A," Proceedings of the National Academy of Sciences U.S.A., 109(51): E3597-E3603 (2012).
McCluskey, A. J. et al., "The Catalytic Subunit of Shiga-like Toxin 1 Interacts with Ribosomal Stalk Proteins and is Inhibited by Their Conserved C-Terminal Domain," Journal of Molecular Biology, 378(2):375-386 (2008).
McCluskey et al., "Shiga-like Toxin 1: Molecular Mechanism of Toxicity and Discovery of Inhibitors", Thesis University of Toronto (2010); retrieved from the Internet: http://hdl.handle.net/1807/32046.
McCluskey et al., "Charged and hydrophobic Surfaces on the A chain of Shiga-like Toxin 1 recognize the C-terminal Domain of Ribosomal Stalk Proteins," PLoS One 7(2):e31191 (2012).
McKenzie, J, et al., "Passage through the Golgi is necessary for Shiga toxin B subunit to reach the endoplasmic reticulum," The FEBS Journal, 276(6):1581-1595, 2008.

(56) References Cited

OTHER PUBLICATIONS

Meeting Abstracts, "33rd Annual Meeting & Pre-Conference Programs of the Society for Immunotherapy of Cancer (SITC 2018)," Washington, D.C., USA, Nov. 7-11, 2018, Journal for ImmunoTherapy of Cancer, vol. 6, Supplement No. 1, Nov. 2018, pp. 1-205.
Meeting Abstracts, "34th Annual Meeting & Pre-Conference Programs of the Society for Immunotherapy of Cancer (SITC 2019): Part 2: National Harbor, MD, USA, Nov. 10, 2019," Journal for ImmunoTherapy of Cancer, vol. 7, Supplement No. 1, Nov. 2019, pp. 1-237, Abstract P804.
Michel, R. B. et al., "Intracellular Accumulation of the Anti-CD20 Antibody 1F5 in B-Lymphoma Cells," Clinical Cancer Research, 8(8):2701-2713 (2002).
Miller, R. B. et al., "Design, Construction, and In-Vitro analyses of Multivalent Antibodies," Journal of Immunology, 170(9):4854-4861 (2003).
Moise, L. et al., "T cell epitope engineering: an avian H7N9 influenza vaccine strategy for pandemic preparedness and response," Human Vaccines & Immunotherapeutics, 14(9):2203-2207 (2018).
Molecular Templates, Molecular Templates Provides Corporate Update and Outlines 2020 Milestones, Jan. 8, 2020, 2 pages.
Molecular Templates, Inc., R&D Day, Conference Call Transcript, Nov. 15, 2019, Fair Disclosure Wire, pp. 1-17; retrieved on Jan. 15, 2021 from https://dialog.proquest.com/professional/docview/2320577373.
Molecular Templates Corporate Presentation, Nov. 2019, 26 pages.
Newland, J. W. et al., "Cloning of Genes for Production of Escherichia coli Shiga-Like Toxin Type II," Infection and Immunity, 55(11):2675-2680 (1987).
Ninkovic, T. et al., "Identification of O-glycosylated decapeptides within the MUC1 repeat domain as potential MHC class I (A2) binding epitopes," Molecular Immunology 47(1):131-140 (2009).
Noakes, K. L. et al., "Exploiting retrograde transport of Shiga-like Toxin 1 for the delivery of exogenous antigens into the MHC class I presentation pathway," FEBS Letters, 453(1-2):95-99 (1999).

Ogishi, M. & Yotsuyanagi, H., "Quantitative Prediction of the Landscape of T Cell Epitope Immunogenicity in Sequence Space," Frontiers in Immunology, vol. 10, Article 827, pp. 1-20(2019).

Ohmura, M. et al., "Characterization of non-toxic mutant toxins of Vero toxin I that were constructed by replacing amino acids in the A subunit," Microbial Pathogenesis, 15(3):169-176 (1993).

Olafsen, T. et al., "Recombinant Anti-CD20 Antibody fragments for Small-Animal PET Imaging of B-Cell Lymphomas," Journal of Nuclear Medicine, 50(9):1500-1508 (2009).

Olafsen, T. et al., "ImmunoPET imaging of B-cell lymphoma using anti-CD20 scFv dimers (diabodies)," Protein Engineering, Design & Selection, 23(4):243-249 (2010).

Oloomi, M. et al., "In vivo characterization of Fusion Protein Comprising of A1 Subunit of Shiga Toxin and Human GM-CSF: Assessment of Its immunogenicity and Toxicity," Iranian Biomedical Journal, 14(4):136-141 (2010).

Onda, M. et al., "An immunotoxin with greatly reduced immunogenicity by identification and removal of B cell epitopes," Proceedings of the National Academy of Sciences U.S.A., 105(32): 11311-11316 (2008).

Osicka, R. et al., "Delivery of CD8+ T-cell epitopes into major histocompatibility complex class I antigen presentation," Infection and Immunity, 68(1):247-256 (2000).

Pai-Scherf, L. H. et al., "Hepatotoxicity in Cancer Patients Receiving erb-38, a Recombinant Immunotoxin that Targets the erbB2 Receptor," Clinical Cancer Research, 5(9):2311-2315 (1999).

Pastan, I. et al., "Immunotoxin Treatment of Cancer," Annual Review of Medicine, 58:221-237 (2007).

Paul, W. E. (Ed.) "Fundamental Immunology" 3rd Edition, Raven Press, 292-295 (1993).

Peng, K. W. et al., "Oncolytic measles viruses displaying a single-chain antibody against CD38, a myeloma cell marker," Blood, 101(7):2557-2562 (2003).

Perampalam, S. et al., "Designing combinatorial protein libraries based on a protein toxin template," Molecular & Cellular Proteomics, American Society for Biochemistry and Molecular Biology, Inc., US, vol. 2, No. 9, Jan. 11, 2003, p. 868.

Perampalam, S. et al., "Designing combinatorial protein libraries based on a protein toxin template," HUPO 2nd Annual & IUBMB IXI World Congress, Oct. 8-11, Montreal, Poster Session 28 Proteomics & Biotechnology, 80.16 (Oct. 2003).

Perampalam, S. et al., "Cell-targeted Ribosome-Inactivating Proteins derived from Protein Combinatorial Libraries," Thesis—University of Toronto (2008), 172 pages.

Peterson, J. K. et al., "Integrating pharmacology and in vivo cancer models in preclinical and clinical drug development," European Journal of Cancer, 40(6):837-844 (2004).

Pirie, C. M. et al., "Convergent Potency of Internalized Gelonin Immunotoxins across Varied Cell Lines, Antigens, and Targeting Moieties," Journal of Biological Chemistry, 286(6):4165-4172 (2011).

Pisarev, V. M. et al., "T cells recognize PD(N/T)R motif common in a variable number of tandem repeat and degenerate repeat sequences of MUC1," International Immunopharmacology, 5(2):315-330 (2005).

Polito, L. et al., "The Conjugate Rituximab/saporin-S6 completely inhibits clonogenic growth of CD20-expressing cells and produces a synergistic toxic effect with Fludarabine," Leukemia 18(7):1215-1222 (2004).

Polito, L. et al., "Saporin-S6: A Useful Tool in Cancer Therapy," Toxins, 5:1698-1722 (2013).

Polson, A. G. et al., "Antibody-Drug Conjugates for the Treatment of Non-Hodgkin's Lymphoma: Target and Linker-Drug Selection," Cancer Research, 69(6):2358-2364 (2009).

Press, O. W. et al., "Endocytosis and Degradation of Monoclonal Antibodies Targeting Human B-Cell Malignancies," Cancer Research, 49(17):4906-4912 (1989).

Press, O. et al., "Retention of B-Cell Specific Monoclonal Antibodies by Human Lymphoma Cells," Blood, 83(5):1390-1397 (1994).

Preville, X, et al., "Eradication of Established Tumors by Vaccination With Recombinant Bordetella pertussis Adenylate Cyclase Carrying the Human Papillomavirus 16 E7 Oncoprotein," Cancer Research, 65(2):641-649 (2005).

Protein ID ABM97743, European Molecular Biology Laboratory (EMBL), Oloomi, M, et al., "synthetic construct partial A1-GMCSF chimeric protein", Sep. 10, 2007.

Promega Technical Reference, Amino Acids, 2018.

Rajagopalan, S. et al.,"CD-20 Specific Engineered Toxin Body Demonstrates Direct Cell Kill of Multiple B-Cell Non-Hodgkin's Lymphoma Types," Blood, 122(21):5152 (2013).

Rajagopalan, S. et al., "CD20-specific Engineered Toxin Body demonstrates direct cell kill of multiple B-cell Non-Hodgkin's lymphoma types," The Journal of Cancer Research, 74(19 Suppl): Abstract # 647, (Oct. 1, 2014); Proceedings: AACR Annual Meeting 2014 (Apr. 5-9, 2014).

Rajagopalan, S. et al,. "CD20-specific Engineered Toxin Body demonstrates direct cell kill of multiple B-cell non-Hodgkin's lymphoma types," The Journal of Cancer Research, 74(19 Suppl):Abstract nr 647.

Rajagopalan, S, et al., "CD38-specific engineered toxin body: Therapeutic potential for multiple myeloma", The Journal of Cancer Research, 74(19 Suppl): Abstract #671, (Oct. 1, 2014) from American Association for Cancer Research (AACR) Annual Meeting 2014, (Apr. 5-9, 2014).

Rajagopalan, S. et al., "CD38-specific engineered toxin body: Therapeutic potential for multiple myeloma," The Journal of Cancer Research, 74(19 Suppl): Abstract nr 671 (Oct. 1, 2014).

Rajagopalan, S. et al., "HER2-targeted engineered toxin body demonstrates selective binding and cell kill of HER2-overexpressing breast cancer," The Journal of Cancer Research, 73(8 Suppl): Abstract #868 (Apr. 15, 2013).

Rajagopalan, S. et al., "HER2-targeted engineered toxin body demonstrates selective binding and cell kill of HER2-overexpressing breast cancer," Proceedings: American Association for Cancer Research (AACR) Annual Meeting 2013, Abstract #868 (Apr. 6-10, 2013).

(56) References Cited

OTHER PUBLICATIONS

Rajagopalan, S. et al., "Next-generation engineered toxin bodies: CD38, PD-L1 and HER2 targeted ETBs," American Association for Cancer Research (AACR) Annual Meeting, 2016, Abstract #595 (Apr. 16-20, 2016).
Rajagopalan, S. et al., "Next-generation engineered toxin bodies: CD38, PD-L1 and HER2 targeted ETBs," The Journal of Cancer Research, 76(14 Suppl) (Jul. 15, 2016), Abstract nr 595.
Rajagopalan, S. et al., "A novel targeted engineered toxin body for treatment of HER2 positive breast cancer," Thirty-Seventh Annual CTRC-AACR San Antonio Breast Cancer Symposium, nr P4-15-17 (Dec. 9-13, 2014).
Ramakrishnan, S. & Houston, L., "Comparison of the Selective Cytotoxic Effects of Immunotoxins Containing Ricin A Chain or Pokeweed Antiviral Protein and Anti-Thy 1.1 Monoclonal Antibodies," Cancer Research, 44(1):201-208 (1984).
Ramos, H. J. et al., Abstract 3900, "The safety and efficacy profile of a PD-L1 directed, Engineered Toxin Body, as a novel targeted direct-cell kill approach for the treatment of PD-L1 expressing cancers," Molecular Templates, AACR Annual Meeting 2019; Mar. 29-Apr. 3, 2019; Atlanta, GA, AACR 2019, 2 pages.
Robinson, G. L. et al., "In vivo efficacy of a CD38-specific engineered toxin body," Clinical Cancer Research, 21(17 Suppl) (Sep. 21, 2015), Abstract A15.
Robinson, G. L. et al., "In vivo efficacy of a CD38-specific engineered toxin body," Proceedings: American Association for Cancer Research (AACR) Special Conference on Hematologic Malignancies: Translating Discoveries to Novel Therapies, Poster A15 (Sep. 21, 2015).
Robinson, G. L. et al., "MT-3724, an engineered toxin body targeting CD20 for non-Hodgkin's lymphoma," Proceedings: American Association for Cancer Research (AACR) 107th Annual Meeting 2016, Abstract #1483 (Apr. 6-10, 2016).
Robinson, G. L. et al., "MT-4019: a de-immunized engineered toxin body targeting CD38 for multiple myeloma," Proceedings: American Association for Cancer Research (AACR) Annual Meeting 2017, Poster, Abstract 2659 (Apr. 1-5, 2017).
Robinson, G. L. et al., "MT-3724, an engineered toxin body targeting CD20 for non-Hodgkin's lymphoma," Proceedings of the 107th Annual Meeting of the American Association for Cancer Research, Cancer Research, Jul. 15, 2016, 76(14 Suppl), Abstract 1483.
Romaniuk, S. I. et al., "Recombinant Diphtheria toxin derivatives: Perspectives of application," Russian Journal of Bioorganic Chemistry, 38(6):565-577 (2012).
Rosenthal, A. et al., "A phase 2 study of lenalidomide, rituximab, cyclophosphamide, and dexamethasone (LR-CD) for untreated low-grade non-Hodgkin lymphoma requiring therapy," Am J Hematol., 92(5):467-472 (2017).
Rossi, E. A. et al., "Novel Designs of Multivalent Anti-CD20 Humanized Antibodies as Improved Lymphoma Therapeutics," Cancer Research, 68(20):8384-8392 (2008).
Roudkenar, M. H. et al., "Selective cytotoxicity of recombinant STXA1-GM-CSF protein in hematopoietic cancer cells," Cell Biology and Toxicology, 22(3):21 3-219 (2006).
Rudikoff, S. et al., "Single amino acid substitution altering antigen-binding specificity," Proceedings of the National Academy of Sciences of the USA, 79(6): 1979-1983 (1982).
Saijo, N. "What are the reasons for negative phase III trials of molecular-target-based drugs?" Cancer Science 95(10):772-776 (2004).
Sandvig, K. et al., "Protein toxins: mode of action and cell entry," Biochemical Society Transactions, 20(4):724-727 (1993).
Sandvig, K. et al., "Entry of Shiga Toxin into Cells," Zentralblatt für Bakteriologie, 278(2-3):296-305 (1993).
Saron, M. F. et al., "Anti-viral protection conferred by recombinant adenylate cyclase toxins from Bordetella pertussis carrying a CD8+ T cell epitope from lymphocytic choriomeningitis virus," Proceedings of the National Academy of Sciences U.S.A., 94(7):3314-3319 (1997).
Schindler, J. et al., "A Phase I Study of a Combination of anti-CD19 and anti-CD22 Immunotoxins (Combotox) in Adult Patients with Refractory B-Lineage Acute Lymphoblastic Leukemia," British Journal of Haematology, 154(4):1-11 (2011).
Schlecht, G. et al., "Antigen Targeting to CD11b Allows Efficient Presentation of CD4+ and CD8+ T Cell Epitopes and In Vivo Th1-Polarized T Cell Priming," The Journal of Immunology, 173(10):6089-6097 (2004).
Schuh, J. C., "Trials, Tribulations, and Trends in Tumor Modeling in Mice," Toxicologic Pathology, 32(Suppl. 1):53-66 (2004).
Schultz, J. C. et al., "A Tetravalent Single-chain Antibody-Streptavidin Fusion Protein for Pretargeted Lymphoma Therapy," Cancer Research, 60(23):6663-6669 (2000).
Schumacher, F.-R. et al., "Building proteomic tool boxes to monitor MHC class I and class II peptides," Proteomics, 17(1-2):1600061 (2017), 16 pages; doi:10.1002/pmic.201600061.
Sebo, P. et al., "Cell-Invasive Activity of Epitope-Tagged Adenylate Cyclase of Bordetella pertussis allows In Vitro Presentation of a Foreign Epitope to CD8+ Cytotoxic T Cells," Infection and Immunity, 63(10):3851-3857 (1995).
Sebo, P. et al., "In vivo induction of CTL responses by recombinant adenylate cyclase of Bordetella pertussis carrying multiple copies of a viral CD8+ T-cell epitope," FEMS Immunology & Medical Microbiology, 26(2):167-173 (1999).
Shan, D. et al., "Characterization of scFV-Ig Constructs Generated from the Anti-CD20 mAb 1F5 Using Linker Peptides of Varying Lengths," Journal of Immunology, 162(11):6589-6595 (1999).
Shaw, C. A. et al., "Stimulation of CD8+ T Cells following Diphtheria Toxin-Mediated Antigen Delivery into Dendritic Cells," Infection and Immunity, 74(2):1001-1008 (2006).
Shen, G. L. et al., "Evaluation of four CD22 antibodies as ricin A chain-containing immunotoxins for the in vivo therapy of human B-cell leukemias and lymphomas," International Journal of Cancer, 42(5):792-797 (1988).
Shete, V., "Generation and characterization of random site-directed mutants of Shiga-like toxin 1A by *Escherichia coli* O157:H7 in *Saccharomyces cerevisiae*," Thesis, Rutgers, The State University of New Jersey, New Brunswick (2009), retrieved from http://dx.doi.org/doi:10.7282/T300029Z.
Shiba, Y. et al., "AGAP2 regulates retrograde transport between early endosomes and the TGN," Journal of Cell Science, 123(Pt 14):2381-2390 (2010).
Sieber, T. et al., "Selective internalization of monoclonal antibodies by B-cell chronic lymphocytic leukemia cells," 121(3):458-461 (2003).
Simsova, M. et al., "The adenylate cyclase toxin from Bordetella pertussis—a novel promising vehicle for antigen delivery to dendritic cells," International Journal of Medical Microbiology, 239:571-576 (2004).
Singh, N. K. et al., "Emerging Concepts in TCR Specificity: Rationalizing and (Maybe) Predicting Outcomes," J Immunol, 199:2203-2213 (2017).
Sivam, G. et al., "Immunotoxin to a Human Melanoma-associated Antigen: Comparison of Gelonin with Ricin and Other A Chain Conjugates," Cancer Research, 47(12):3169-3173 (1987).
Skinner, L. M. & Jackson, M. P., "Investigation of ribosome binding by the Shiga Toxin A1 subunit, using competition and site-directed mutagenesis," Journal of Bacteriology, 179(4): 1368-1374 (1997).
Skinner, L. M. & Jackson, M. P., "Inhibition of prokaryotic translation by the Shiga toxin enzymatic subunit," Microbial Pathogenesis, 24(2):117-122 (1998).
Smith, D. C. et al., "Exogenous Peptides Delivered by Ricin Require Processing by Signal Peptidase for Transporter Associated with Antigen Processing-Independent MHC Class I-Restricted Presentation," The Journal of Immunology, 169(1):99-107 (2002).
Stenmark, H. et al., "Peptides fused to the amino-terminal end of Diphtheria toxin are translocated to the cytosol," The Journal of Cell Biology, 113(5):1025-1032 (1991).
Stepanov, A. et al., "Design of Targeted B Cell Killing Agents," PLoS One, 6(6):e20991 (2011); doi:10.1371/journal.pone.0020991, 10 pages.

(56) References Cited

OTHER PUBLICATIONS

Strop, P. et al., "Location Matters: Site of Conjugation Modulates Stability and Pharmacokinetics of Antibody Drug Conjugates," Chemistry & Biology, 20:161-167 (2013).
Su, H. et al., "Clinical grade production and characterization of a fusion protein comprised of the chemokine CCL2-ligand genetically fused to a mutated and truncated form of the Shiga A1 subunit," Protein Expression and Purification, 66(2):149-157 (2009).
Suh, J. K. et al., "Shiga Toxin Attacks Bacterial Ribosomes as Effectively as Eucaryotic Ribosomes," Biochemistry, 37(26):9394-9398 (1998).
Suhan, M. L. et al., "Disruption of an Internal Membrane-Spanning Region in Shiga Toxin I Reduces Cytotoxicity," Infection and Immunity, 66(11):5252-5259 (1998).
Tacken, P. J. et al., "Effective induction of naive and recall T-cell responses by targeting antigen to human dendritic cells via a humanized anti-DC-SIGN antibody," Blood, 106(4): 1278-85 (2005).
Tesh, V. L. et al., "Comparison of the Relative Toxicities of Shiga-Like Toxins Type I and Type II for Mice," Infection and Immunity, 61(8):3392-3402 (1993).
Thompson, J. et al., "Improved binding of a bivalent single-chain immunotoxin results in increased efficacy for in vivo T-cell depletion," Protein Engineering, 14(12):1035-1041 (2001).
Thorpe, P. E. et al., "Cytotoxicity Acquired by Conjugation of an Anti-Thy1.1 Monoclonal Antibody and the Ribosome-Inactivating Protein, Gelonin," European Journal of Biochemistry, 116(3):447-454 (1981).
Torgersen, M. L. et al., "The A-subunit of surface-bound Shiga toxin stimulates clathrin-dependent uptake of the toxin," The FEBS Journal, 272(16):4103-4013 (2005).
Tosatto, C. E. et al., "Large-Scale Prediction of Protein Structure and Function from Sequence," Current Pharmaceutical Design, 12(17):2067-2086 (2006).
Vallera, D. A. et al., "Bioengineering a unique deimmunized bispecific targeted toxin that simultaneously recognizes human CD22 and CD19 Receptors in a mouse model of B-Cell metastases," Molecular Cancer Therapeutics, 9(6):1872-1883 (2010).
Varner, C. T. et al., "Recent Advances in Engineering Polyvalent Biological Interactions," Biomacromolecules, 16(1):43-55 (2014).
Vernet, E. et al., "Affinity-based entrapment of the HER2 receptor in the endoplasmic reticulum using an affibody molecule," Journal of Immunological Methods, 338:1-6 (2008).
Vervoordeldonk, S. F. et al., "Preclinical studies with radiolabeled monoclonal antibodies for treatment of patients with B-cell malignancies," Cancer, 73(3): 1006-1011 (1994).
Vingert, B. et al., "The Shiga toxin B-subunit targets antigen in vivo to dendritic cells and elicits anti-tumor immunity," European Journal of Immunology, 36(5):1124-1135 (2006).
Von Minckwitz, G. et al., "Phase I clinical study of the recombinant antibody toxin scFv(FRP5)-ETA specific for the ErbB2/HER2 receptor in patients with advanced solid malignomas," Breast Cancer Research, 7(5):R617-R626 (2005).
Voskoglou-Nomikos, T. et al., "Clinical Predictive Value of the In Vitro Cell Line, Human Xenograft, and Mouse Allograft Preclinical Cancer Models," Clinical Cancer Research, 9(11): 4227-4239 (2003).
Wales, R. et al., "Addition of an endoplasmic reticulum retrieval sequence to ricin A chain significantly increases its cytotoxicity to mammalian cells," Journal of Biological Chemistry, 268(32):23986-23990 (1993).
Wang, E. et al., "T-cell-directed cancer vaccines: the melanoma model," Expert Opinion on Biological Therapy, 1(2):277-290 (2001).
Wargalla, U. D. & Reisfeld, R. A., "Rate of internalization of an immunotoxin correlates with cytotoxic activity against human tumor cells," PNAS USA, 86(13):5146-5150 (1989).
Weinstein, D. et al., "In vivo formation of hybrid toxins comprising Shiga toxin and the Shiga-like toxins and role of the B subunit in localization and cytotoxic activity," Infection and Immunity, 57(12):3743-3750 (1989).
Weldon, J. E. & Pastan, I., "A guide to taming a toxin: recombinant immunotoxins constructed from Pseudomonas exotoxin A for the treatment of cancer," FEBS Journal, 278(23):4683-4700 (2011).
Willert, E. K. et al., "Engineered toxin bodies: A next-generation immunotoxin scaffold with novel immunooncology functionality," Proceedings: American Association for Cancer Research (AACR) Annual Meeting 2015, Abstract #2477 (Apr. 18-22, 2015).
Willert, E. K. et al., "A novel targeted engineered toxin body for treatment of HER2 positive breast cancer," The Journal of Cancer Research, 75(9 Suppl) Abstract nr P4-15-17 (May 1, 2015).
Willert, E. K. et al., "Engineered toxin bodies: A next-generation immunotoxin scaffold with novel immuno-oncology functionality," The Journal of Cancer Research, 75(15 Suppl): Abstract nr 2477 (Aug. 1, 2015).
Willert, E. K. et al., "TAK-169, an exceptionally potent CD38 targeted engineered toxin body, as a novel direct cell kill approach for the treatment of multiple myeloma," Proceedings: American Association for Cancer Research (AACR) Annual Meeting 2019, Poster #2384 (Apr. 1, 2019).
Windschiegl, B. et al., "Lipid Reorganization Induced by Shiga Toxin Clustering on Planar Membranes," PLoS One, 4(7):e6238 (2009).
Wirth, R. et al., "Engineered Toxin Body demonstrating CD20-specific binding and cell kill in B-Cell Non-Hodgkin lymphoma cells," Proceedings: American Association for Cancer Research (AACR) 104th Annual Meeting 2013, Abstract #5477 (Apr. 6-10, 2013).
Wirth, R. et al., "Engineered Toxin Body demonstrating CD20-specific binding and cell kill in B-Cell NonHodgkin lymphoma cells," [Abstract], In: Proceedings of the 104th Annual Meeting of the American Association for Cancer Research, Cancer Research, Apr. 15, 2013, 73(8 Suppl) Abstract #5477.
Wu, A. M. et al., "Multimerization of a chimeric anti-CD20 single chain Fv-Fc fusion protein is mediated through variable domain exchange," Protein Engineering, 14(12):1025-1033 (2001).
Wu, H. et al., "Humanization of a murine monoclonal antibody by simultaneous optimization of framework and CDR residues," J. Mol. Biol., 294:151-162 (1999).
Yamasaki, S. et al., "Importance of arginine at position 170 of the A subunit of Vero toxin 1 produced by enterohemorrahagic Escherichia coli for toxin activity," Microbial Pathogenesis, 11(1):1-9 (1991).
Yu, L. et al., "Interaction between bevacizumab and murine VEGF-A: a reassessment," Investigative Ophthalmology & Visual Science, 49(2):522-527 (2008).
Zacny, V. et al., "Novel toxin library for the discovery of oncology therapeutics," Cancer Research, 70(8 Suppl), Abstract #5506 (Apr. 2010).
Zahid, M. et al., "Design and reshaping of an scFv directed against human platelet glycoprotein VI with diagnostic potential," Analytical Biochemistry, 417(2):274-282 (2011).
Zapata, G. et al., "Engineering linear F(ab')2 fragments for efficient production in Escherichia coli and enhanced antiproliferative activity," Protein Engineering, 8(10):1057-1062 (1995).
U.S. Appl. No. 16/540,789, filed Aug. 14, 2019.
U.S. Appl. No. 17/030,657, filed Sep. 24, 2020.
U.S. Appl. No. 15/899,428, filed Feb. 20, 2018.
U.S. Appl. No. 16/480,591, filed Jul. 24, 2019.
U.S. Appl. No. 16/467,737, filed Jun. 7, 2019.
U.S. Appl. No. 17/314,563, filed May 7, 2021.
U.S. Appl. No. 16/220,468, filed Dec. 14, 2018.
U.S. Appl. No. 17/231,526, filed Apr. 15, 2021.
U.S. Appl. No. 15/577,827, filed Nov. 29, 2017.
U.S. Appl. No. 17/233,911, filed Apr. 19, 2021.
U.S. Appl. No. 15/125,126, filed Sep. 9, 2016.
U.S. Appl. No. 15/114,487, filed Jul. 27, 2016.
U.S. Appl. No. 15/125,142, filed Sep. 9, 2016.
U.S. Appl. No. 16/013,600, filed Jun. 20, 2018.
U.S. Appl. No. 17/027,120, filed Sep. 21, 2020.
https://www.genome.gov/genetics-glossary/antisense; retrieved on Jul. 17, 2021, 2 pages.
Kochenderfer, J. N. et al., "Construction and Pre-clinical Evaluation of an Anti-CD19 Chimeric Antigen Receptor," J Immunother., 32(7):689-702 (2009).

(56) References Cited

OTHER PUBLICATIONS

Muzard, J. et al., "Grafting of protein L-binding activity onto recombinant antibody fragments," Analytical Biochemistry, 388(2): 331-338 (2009).

Nilson, B. H. K. et al., "Protein L from Peptostreptococcus magnus binds to the kappa light chain variable domain," Journal of Biological Chemistry, 267(4):2234-2239 (1992).

Nilson, B. H. K. et al., "Purification of antibodies using protein L-binding framework structures in the light chain variable domain," Journal of Immunological Methods, 164(1):33-40 (1993).

Wels, W. et al., "Selective Inhibition of Tumor Cell Growth by a Recombinant Single-Chain Antibody-Toxin Specific for the erbB-2 Receptor," Cancer Research, 52:6310-6317 (1992).

\* cited by examiner

Figure 1-A. Schematic Drawing of Exemplary Cell-Targeting Molecules, each Having a Heterologous, CD8+ T-Cell Epitope Positioned Carboxy Terminal to a Furin-Cleavage Resistant, De-Immunized, Shiga Toxin Effector Having an Embedded, T-Cell Epitope Figure 1-B. Schematic Drawing of Additional, Exemplary, Cell-Targeting Molecules, Each Comprising a De-Immunized Shiga Toxin Effector Having an Embedded, T-Cell Epitope Figure 2. Specific Cytotoxicity of SLTA-1A-DI-FR::scFv1::C2 and SLTA-1A-DI-FR::scFv1 to Target Positive Cells
A.
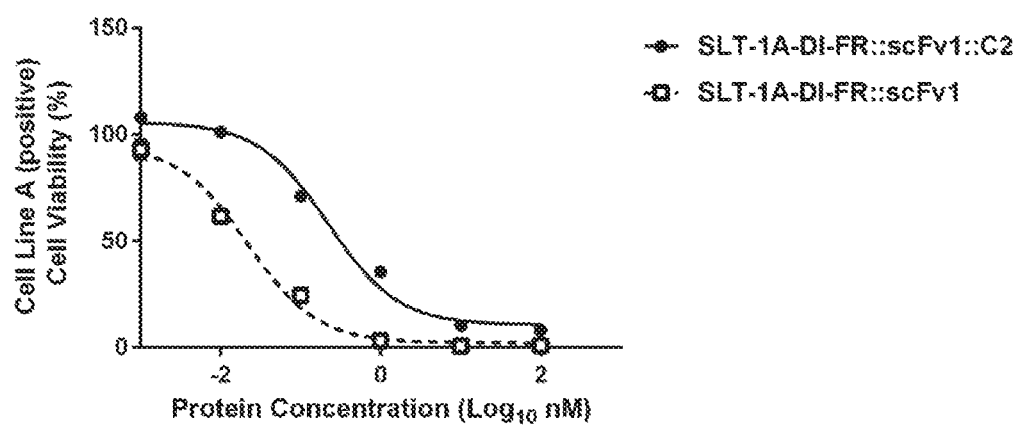
B.
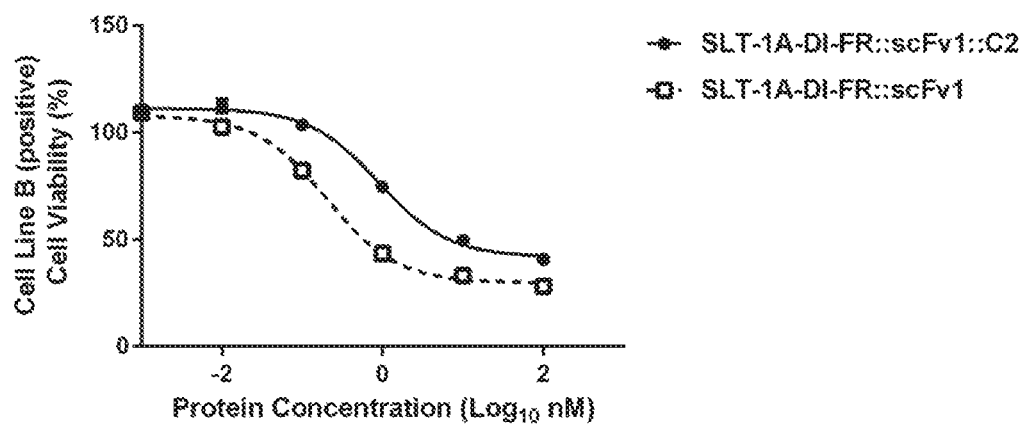
C.
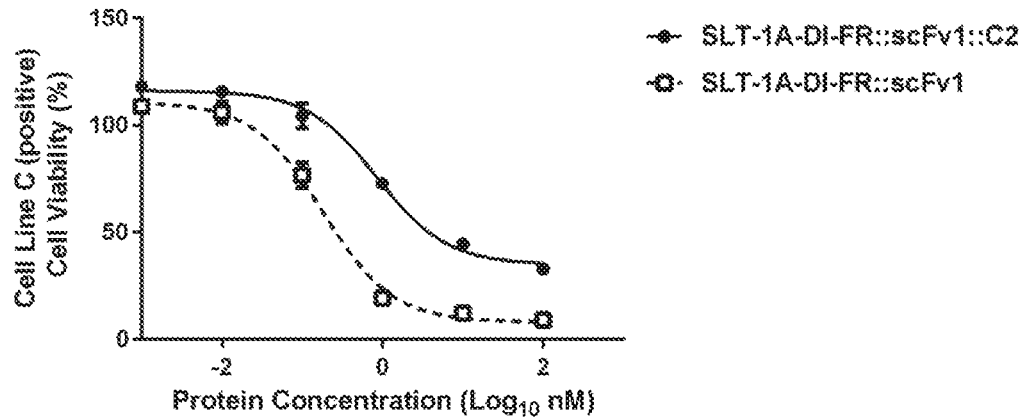

Figure 3. Flow Cytometry Data Showing Cell-Surface MHC Class I Display of the C2 Epitope by Target Positive Cancer Cells Treated with SLTA-1A-DI-FR::scFv1::C2
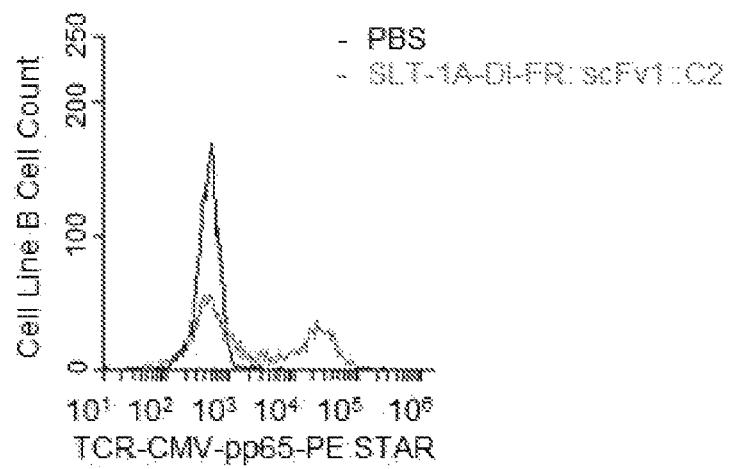
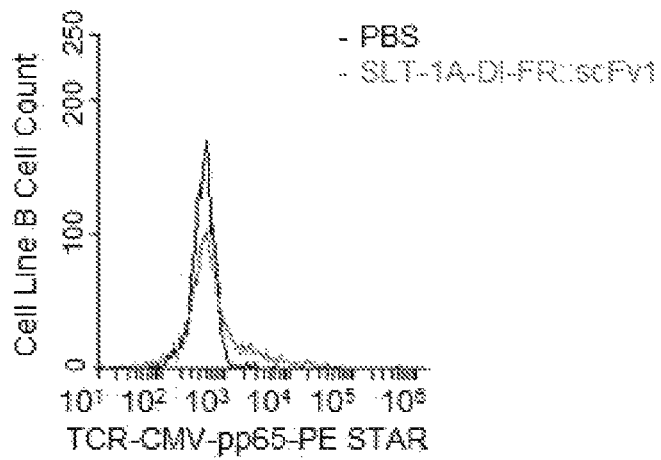
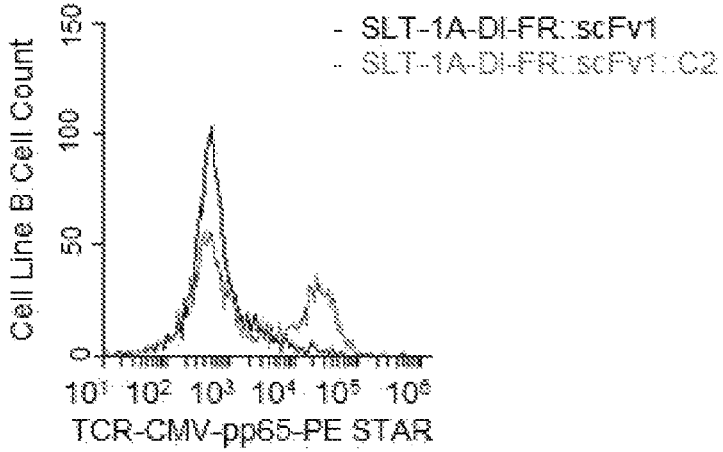

Figure 4. Size Exclusion Chromatography Profile of a Preparation of SLTA-1A-DI-FR::scFv1::C2 Analyzed under Native Conditions Figure 5. Picture of a Coomassie-Stained, SDS-PAGE Gel Showing Preparations of SLTA-1A-DI-FR::scFv1::C2 and SLTA-1A-DI-FR::scFv1 Analyzed in Reduced and Denaturing Conditions 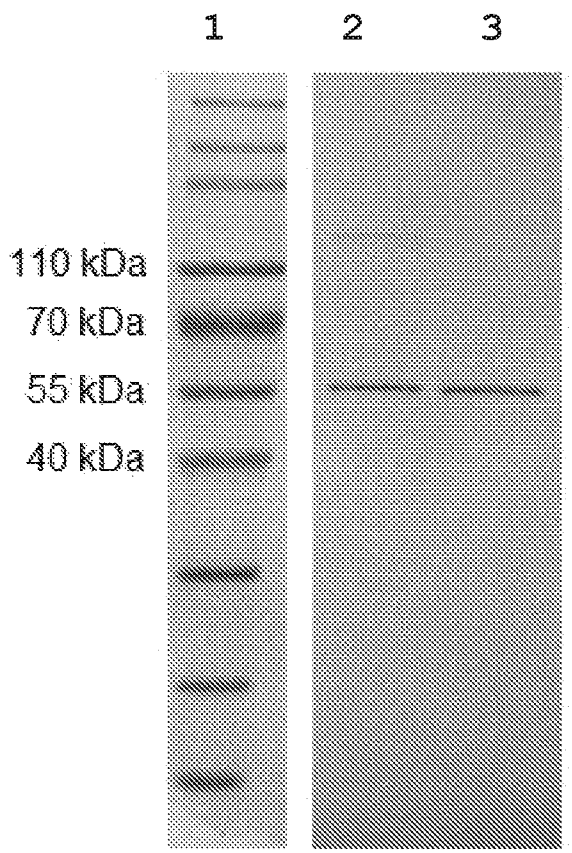 1. MW ladder
2. SLT-1A-DI-FR::scFv1::C2
3. SLT-1A-DI-FR::scFv1

Figure 6. Specific Cytotoxicity of SLT-1A::scFv1::C2 as compared to SLT-1A-WT to Target Positive Cells Figure 7. Lack of Cytotoxicity of SLT-1A::scFv1::C2 to Target Negative Cells over the Concentration Range Tested Figure 8. Flow Cytometry Data Showing Cell-Surface MHC Class I Display of the C2 Epitope by Target Positive Cancer Cells Treated with SLT-1A::scFv1::C2

Figure 9. TCR-STAR™ Assay Data Showing Cell-Surface MHC Class I Display of the C2 Epitope by Target Positive Cancer Cells Treated with "inactive SLT-1A::scFv2::C2"

Figure 10. Flow Cytometry Data Showing Cell-Surface MHC Class I Display of the C2 Epitope by Target Positive Cells Treated with SLT-1A::scFv1::C2 for 4 or 16 Hours Figure 11. Flow Cytometry Data Showing Cell-Surface MHC Class I Display of the C2 Epitope by Target Positive Cancer Cells Treated with SLT-1A::scFv5::C2

Figure 12. Flow Cytometry Data Showing Cell-Surface MHC Class I Display of the C2 Epitope by Target Positive Cancer Cells Treated with SLT-1A::scFv7::C2

Figure 13. Interferon Gamma Secretion by PBMCs Recognizing C2 Epitope Presentation by Target Positive Cancer Cells Treated with "inactive SLTA-1A::scFv2::C2"

Figure 14. Light Signal Detected from Reporter T-Cells Recognizing F2 Epitope Presentation by Target Positive Cancer Cells Treated with "inactive SLTA-1A::scFv6::F2"

Figure 15. Interferon Gamma Secretion by PBMCs Recognizing C2 Epitope Presentation by Target Positive Cancer Cells Contacted with "inactive SLTA-1A-DI-4::scFv6::(C2)₃"

Figure 16. Immune-Cell Mediated Killing of Target Positive Cancer Cells Induced After Being Contacted with "inactive SLTA-1A-DI-4::scFv6::(C2)₃"

Figure 17. Immune Cell Activation and Clustering in the Presence of C2 Epitope Presentation by Target Positive Cancer Cells Contacted with "inactive SLTA-1A-DI-4::scFv6::(C2)$_3$"

Figure 18. Interferon Gamma Secretion by PBMCs Recognizing C2 Epitope Presentation by Target Positive Cancer Cells Contacted with "inactive SLT-1A-DI-1::scFv8::C2"

Figure 19. Killing of Cancer Cells by PBMCs Recognizing C2 Epitope Presentation by Target Positive Cancer Cells Contacted with "inactive SLT-1A-DI-1::scFv8::C2"

Figure 20. Killing of Cancer Cells and Interferon Gamma Secretion by PBMCs Recognizing C2 Epitope Presentation by Target Positive Cancer Cells Contacted with Active SLT-1A-DI-1::scFv8::C2

CELL-TARGETING MOLECULES COMPRISING DE-IMMUNIZED, SHIGA TOXIN A SUBUNIT EFFECTORS AND CD8+ T-CELL EPITOPES

CROSS REFERENCE TO RELATED APPLICATIONS

This application is a continuation of U.S. application Ser. No. 16/480,591, filed Jul. 24, 2019, which is a national stage of International Application No. PCT/US2018/014942, filed on Jan. 24, 2018, which claims priority to U.S. Provisional Application No. 62/450,506, filed on Jan. 25, 2017, the contents of which are incorporated herein by reference in their entirety for all purposes.

INCORPORATION BY REFERENCE OF SEQUENCE LISTING

The content of the text file submitted electronically herewith is incorporated herein by reference in its entirety: A computer readable format copy of the Sequence Listing (filename: MTEM_004_02US_SeqList_ST25.txt, date created: Apr. 12, 2021, file size: about 2,234 kilobytes).

TECHNICAL FIELD

The present invention relates to cell-targeting molecules which each comprise (1) a binding region for cell-targeting, (2) a Shiga toxin A Subunit effector polypeptide for subcellular delivery, and (3) one or more, CD8+ T-cell epitopes which is heterologous to the Shiga toxin A Subunit effector polypeptide; wherein the cell-targeting molecule is capable of delivering at least one, heterologous, CD8+ T-cell epitope to the MHC class I presentation pathway of a target cell, such as, e.g. a malignant cell. The Shiga toxin effector polypeptide components of the cell-targeting molecules of the present invention comprise a combination of mutations relative to a wild-type Shiga toxin sequence providing (1) de-immunization, (2) a reduction in protease sensitivity, and/or (3) an embedded, T-cell epitope(s); wherein each Shiga toxin effector polypeptide retains one or more Shiga toxin function, such as, e.g., stimulating cellular internalization, directing intracellular routing, and/or potent cytotoxicity. In certain embodiments, the cell-targeting molecule of the present invention can deliver the heterologous, CD8+ T-cell epitope to the MHC class I presentation pathway of a target cell wherein the heterologous, CD8+ T-cell epitope is linked, either directly or indirectly, carboxy-terminal to the carboxy-terminus of a Shiga toxin A1 fragment derived region of the Shiga toxin A Subunit effector polypeptide. In certain embodiments, the cell-targeting molecules of the present invention are useful for administration to chordates, such as, e.g., when it is desirable to (1) reduce or eliminate a certain immune response(s) resulting from the administered molecule, (2) reduce or eliminate non-specific toxicities resulting from the administered molecule, (3) specifically kill a target cell(s) in vivo, and/or (4) target a beneficial immune response(s) to a target cell-type, a tumor mass comprising a target cell-type, and/or a tissue locus comprising a target cell-type, such as via stimulating intercellular engagement of a CD8+ T-cell(s) of the chordate with the target cell-type. The cell-targeting molecules of the present invention have numerous uses, e.g., for the delivery of a specific CD8+ T-cell epitope from an extracellular location to the MHC class I presentation pathway of a target cell; the cell-surface labeling of a target cell with a MHC class I displayed CD8+ T-cell epitope; the selective killing of specific cell-types in the presence of other cells; the stimulation of beneficial immune responses in vivo; the elicitation of a cytotoxic T lymphocyte cell response(s) to a target cell; the repression of a detrimental immune response(s) in vivo; the creation of memory immune cells, and the diagnosis and treatment of a variety of diseases, disorders, and conditions, such as, e.g., cancers, tumors, other growth abnormalities, immune disorders, and microbial infections.

BACKGROUND

The following includes information that may be useful in understanding the invention(s) described herein. It is not an admission that any of the information provided herein is prior art or relevant to the presently described or claimed invention(s), or that any publication or document that is specifically or implicitly referenced herein is prior art.

The concept of harnessing the power of the immune system to treat cancer is over one hundred years old (see e.g. Wiemann B, Starnes C, *Pharmacol Ther* 64: 529-64 (1994)). For example, William Coley used patients' reactions to inactivated infectious agents to improve their immune defenses to cancers. By triggering infection-like immune reactions, the patient's immune system became stimulated and showed improved immunosurveillance of cancer cells, often leading to disease remission. It may be possible to improve upon this concept by using targeted therapeutics and by limiting or focusing immune reactions to localized areas, such as, e.g., via the exquisite specificity of the adaptive immune system. Targeted therapies may be used to target cancer cells and/or cancer tissue loci within a patient for the receipt of highly immunogenic, foreign epitopes (e.g., from an infectious agent) in order to locally activate a variety of beneficial immune responses and to specifically mark cancer cells as being foreign using epitopes which are more immunogenic than any already displayed by the cancer cells in the patient. Further, by inducing an imitation of an infected state for a large number of targeted cancer cells, the patient's immune system may become systemically stimulated such as, e.g., including an increase in global immunosurveillance and immune cell activity, but the exquisite specificity of the immune system may limit or focus immune responses to a certain tissue location, cell-type(s), or even a single foreign epitope(s). This approach may activate the immune system generally in a systemic way (such as shown with Coley's toxins, cytokine therapies, immune-checkpoint inhibitors, and cancer vaccines) while focusing beneficial immune responses to certain tissues and cells in a localized way (such as shown with adoptive chimeric antigen receptor-engineered T cell (CAR-T) and tumor-targeted monoclonal antibody therapies).

The major histocompatibility (MHC) class I system plays an essential role in the immune system by providing epitope presentation of intracellular antigens (*Cellular and Molecular Immunology* (Abbas A, ed., Saunders, 8$^{th}$ ed., 2014)). This process is thought to be an important part of the adaptive immune system, a system which evolved in chordates primarily to protect against intracellular pathogens as well as malignant cells expressing intracellular antigens, such as, e.g., cancer cells. For example, human infections involving intracellular pathogens may only be overcome by the combined actions of both the MHC class I and class II systems (see e.g. Chiu C, Openshaw P, *Nat Immunol* 16: 18-26 (2015)). The MHC class I system's contribution is to identify and kill malignant cells based on the identification of intracellular antigens.

The MHC class I system functions in any nucleated cell of a vertebrate to present intracellular (or endogenous) antigens, whereas the MHC class QI pathway functions in professional antigen-presenting cells (APCs) to present extracellular (or exogenous) antigens (Neefjes J et al., *Nat Rev Immunol* 11: 823-36 (2011)). Intracellular or "endogenous" epitopes recognized by the MHC class I system are typically fragments of molecules encountered in the cytosol or lumen of the endoplasmic reticulum (ER) of a cell, and these molecules are typically proteolytically processed by the proteasome and/or another protease(s) in the cytosol. When present in the ER, these endogenous epitopes are loaded onto MHC class I molecules and presented on the surface of the cell as peptide-MHC class I molecule complexes (pMHC Is). In contrast, the MHC class II system functions only in specialized cells to recognize exogenous epitopes derived from extracellularly encountered molecules processed only in specific endosomal compartments, such as, e.g., late endosomes, lysosomes, phagosomes, and phagolysosomes, and including intracellular pathogens residing in endocytotic organelles.

The presentation of specific epitope-peptides complexed with MHC class I molecules by nucleated cells in chordates plays a major role in stimulating and maintaining immune responses to intracellular pathogens, tumors, and cancers. Intercellular CD8+ T lymphocyte (T-cell) engagement of a cell presenting a specific epitope-MIC class I complex by a CD8+ T-cell initiates protective immune responses that can result in the rejection of the presenting cell, i.e. death of the presenting cell due to the cytotoxic activity of one or more cytotoxic T lymphocytes (CTLs). The specificity of this intercellular engagement is determined by multiple factors. CD8+ T-cells recognize pMHC Is on the cell surface of another cell via their TCRs. CD8+ T-cells express different T-cell receptors (TCRs) with differing binding specificities to different cognate pMHC Is. CD8+ T-cell specificity depends on each individual T-cell's specific TCR and that TCR's binding affinity to the presented epitope-MHC complex as well as the overall TCR binding occupancy to the presenting cell. In addition, there are diverse variants of MHC class I molecules that influence intercellular CD8+ T-cell recognition in at least in two ways: by affecting the specificity of peptides loaded and displayed (i.e. the pMHC I repertoire) and by affecting the contact regions between TCRs and pMHC Is involved in epitope recognition.

The presentation of certain epitopes complexed with MHC class I molecules can sensitize the presenting cell to targeted killing by lysis, induced apoptosis, and/or necrosis. CTL killing of pMHC I-presenting cells occurs primarily via cytolytic activities mediated by the delivery of perforin and/or granzyme into the presenting cell via cytotoxic granules (see e.g. Russell J, Ley T, *Annu Rev Immunol* 20: 323-70 (2002); Cullen S, Martin S, *Cell Death Diff* 15: 251-62 (2008)). Other CTL-mediated target cell killing mechanisms involve inducing apoptosis in the presenting cell via TNF signaling, such as, e.g., via FasL/Fas and TRAIL/TRAIL-DR signaling (see e.g. Topham D et al., *J Immunol* 159: 5197-200 (1997); Ishikawa E et al., *J Virol* 79: 7658-63 (2005); Brincks E et al., *J Immunol* 181: 4918-25 (2008); Cullen S, Martin S, *Cell Death Diff* 15: 251-62 (2008)). Furthermore, activated CTLs can indiscriminately kill other cells in proximity to the recognized, pMHC I-presenting cell regardless of the peptide-MHC class I complex repertoires being presented by the other proximal cells (Wiedemann A et al., *Proc Natl Acad Sci USA* 103: 10985-90 (2006)). In addition, activated CTLs can release immuno-stimulatory cytokines, interleukins, and other molecules to influence the immuno-activation of the microenvironment.

This MHC class I and CTL immunosurveillance system could conceivably be harnessed by certain therapies to guide a subject's adaptive immune system into rejecting and specifically killing certain cell types. In particular, the MHC class I presentation pathway may be exploited by various therapeutic molecules to force certain targeted cells to display certain epitopes on cell surfaces in order to induce desired immune responses including the increasing immuno-detection and killing of specifically targeted cells by immune cells. Therapeutic molecules might be designed which specifically deliver CD8+ T-cell epitopes to the MHC class I pathway for presentation by malignant cells (e.g. tumor or infected cells) to signal their own destruction and, perhaps, in the aggregate to educe a more wide-spread stimulation of the immune system. In addition, therapeutic molecules might be designed which also stimulate or increase MHC presentation activity in target cells.

It would be desirable to have cell-targeting molecules capable, when exogenously administered, of delivering a CD8+ T-cell epitope to the MHC class I presentation pathway of a chosen target cell, where the epitope may be chosen form a wide variety of epitopes, such as, e.g., from common infectious agents, and the target cell may be chosen from a wide variety of cells, such as, e.g., malignant and/or infected cells, particularly cells other than professional APCs like dendritic cells. Such cell-targeting molecules, which preferentially target malignant cells over healthy cells, may be administered to a chordate for in vivo delivery of a CD8+ T-cell epitope for MHC class I presentation by target cells, such as, e.g., infected, neoplastic, or otherwise malignant cells. In addition, it may be desirable in certain circumstances to have such cell-targeting molecules that also directly kill target cells via a non-immune system based mechanism. Furthermore, it would be desirable to have such cell-targeting molecules that also exhibit low antigenicity, low immunogenicity, high stability, and/or low non-specific toxicity after administration to a chordate.

SUMMARY OF THE INVENTION

The present invention provides various embodiments of cell-targeting molecules, and compositions thereof, wherein each cell-targeting molecule comprises 1) at least one Shiga toxin A Subunit effector polypeptide derived from the A Subunit of at least one member of the Shiga toxin family, 2) at least one binding region capable of specifically binding at least one extracellular target biomolecule, and 3) at least one CD8+ T-cell epitope-peptide cargo; and wherein each cell-targeting molecule is capable of delivering, from an extracellular location, the at least one CD8+ T-cell epitope-peptide to the MHC class I presentation pathway of a cell. For each cell-targeting molecule of the present invention, the at least one binding region is heterologous to the Shiga toxin A Subunit effector polypeptide. For certain embodiments of the cell-targeting molecule of the present invention, the at least one Shiga toxin effector polypeptide (i) has a Shiga toxin A1 fragment derived region having a carboxy-terminus, (ii) comprises a disruption of at least one, endogenous, B-cell and/or CD4+ T-cell epitope region, and (iii) comprises a disrupted furin-cleavage motif at the carboxy-terminus of the A1 fragment derived region. For each cell-targeting molecule of the present invention, the at least one CD8+ T-cell epitope-peptide cargo is (i) heterologous to the Shiga toxin A Subunit effector polypeptide and (ii) not embedded or inserted in the Shiga toxin A1 fragment region and/or the Shiga toxin A Subunit effector polypeptide (see e.g. FIG. 1, depicting illustrative examples of exemplary embodiments of cell-targeting molecules of the present invention).

For certain embodiments of the cell-targeting molecule of the present invention, upon administration of the cell-targeting molecule to a cell results in (i) the internalization of the cell-targeting molecule by the cell and (ii) the cell presenting on a cellular surface the CD8+ T-cell epitope-peptide cargo complexed with a MHC class I molecule.

For certain embodiments of the cell-targeting molecule of the present invention, upon administration of the cell-targeting molecule to a cell, which is physically coupled with extracellular target biomolecule bound by the binding region of the cell-targeting molecule, results in the cell presenting on a cellular surface the CD8+ T-cell epitope-peptide cargo complexed with a MHC class I molecule. In certain further embodiments, having or placing the cell in the presence of an immune cell(s) further results in an immune cell response in trans, an inter-cellular engagement of the cell by an immune cell (e.g. a cytotoxic T lymphocyte), and/or death of the cell induced via an inter-cellular action(s) of an immune cell.

For certain embodiments of the cell-targeting molecule of the present invention, upon administration of the cell-targeting molecule to a chordate, which comprises cells physically coupled with extracellular target biomolecule bound by the binding region of the cell-targeting molecule, results in at least some of said cells presenting on a cellular surface the CD8+ T-cell epitope-peptide cargo complexed with a MHC class I molecule. In certain further embodiments, the results further include an immune cell response in trans, such as, e.g., the inter-cellular engagement of at least some of said cells by an immune cell and/or death of the cell induced via an inter-cellular action(s) of an immune cell (e.g. a cytotoxic T lymphocyte).

Cell-targeting molecules of the present invention may be used for targeted delivery of various CD8+ T-cell epitopes to any nucleated, target cell within a chordate in order to cause the delivered CD8+ T-cell epitope-peptide cargo to be presented on the target cell surface complexed with a MHC class I molecule. The target cells can be of various types, such as, e.g., neoplastic cells, infected cells, cells harboring intracellular pathogens, and other undesirable cells, and the target cell can be targeted by cell-targeting molecules of the invention either in vitro or in vivo. In addition, the present invention provides various cell-targeted molecules comprising protease-cleavage resistant, Shiga toxin effector polypeptides capable of intracellular delivery of heterologous, CD8+ T-cell epitopes to the MHC class I presentation pathways of target cells while simultaneously improving extracellular, in vivo tolerability of these cell-targeting molecules. Certain cell-targeting molecules of the present invention have improved usefulness for administration to chordates as either a therapeutic and/or diagnostic agent because of the reduced likelihood of producing nonspecific toxicities at a given dosage.

In certain embodiments of the cell-targeting molecule of the present invention, the CD8+ T-cell epitope-peptide cargo is fused, either directly or indirectly, to the Shiga toxin A Subunit effector polypeptide and/or the binding region. In certain further embodiments of the cell-targeting molecule of the present invention, the CD8+ T-cell epitope-peptide cargo is fused via a peptide bond, either directly or indirectly, to the Shiga toxin A Subunit effector polypeptide and/or the binding region, the CD8+ T-cell epitope-peptide cargo is fused via a peptide bond, either directly or indirectly, to the Shiga toxin A Subunit effector polypeptide and/or the binding region as a genetic fusion.

In certain embodiments, the cell-targeting molecule of the present invention comprises a polypeptide comprising the binding region, the Shiga toxin effector polypeptide, and the CD8+ T-cell epitope-peptide cargo.

In certain embodiments, the cell-targeting molecule of the present invention comprises the binding region comprising two or more polypeptide chains and the CD8+ T-cell epitope-peptide cargo is fused to a polypeptide comprising the Shiga toxin effector polypeptide and one of the two or more polypeptide chains.

In certain embodiments of the cell-targeting molecule of the present invention, the CD8+ T-cell epitope-peptide cargo is positioned carboxy-terminal to the carboxy terminus of the Shiga toxin A1 fragment derived region.

In certain embodiments, the cell-targeting molecule of the present invention comprises a molecular moiety associated with the carboxy-terminus of the Shiga toxin A Subunit effector polypeptide. In certain further embodiments, the molecular moiety comprises the binding region.

In certain embodiments, the cell-targeting molecule of the present invention comprises a molecular moiety associated with the carboxy-terminus of the Shiga toxin A Subunit effector polypeptide wherein the molecular moiety is cytotoxic.

In certain embodiments, the cell-targeting molecule of the present invention comprises a molecular moiety which comprises at least one amino acid and the Shiga toxin A Subunit effector polypeptide is linked to at least one amino acid residue of the molecular moiety. In certain further embodiments, the molecular moiety and the Shiga toxin A Subunit effector polypeptide are fused forming a continuous polypeptide.

For certain embodiments of the cell-targeting molecule of the present invention, the Shiga toxin A Subunit effector polypeptide is capable of exhibiting one or more Shiga toxin effector functions in addition to delivery of the CD8+ T-cell epitope-peptide cargo to a MHC class I molecule of the cell. For certain embodiments of the cell-targeting molecule of the present invention, the Shiga toxin A Subunit effector polypeptide is capable of exhibiting one or more Shiga toxin effector functions in addition to delivery of the CD8+ T-cell epitope-peptide cargo from an early endosomal compartment of a cell in which the Shiga toxin effector polypeptide is present to a MHC class I molecule of the cell.

For certain embodiments of the cell-targeting molecule of the present invention, the Shiga toxin A Subunit effector polypeptide is capable of exhibiting a ribosome inhibition activity with a half-maximal inhibitory concentration ($IC_{50}$) value of 10,000 picomolar or less.

In certain embodiments of the cell-targeting molecule of the present invention, the Shiga toxin A Subunit effector polypeptide comprises one or more mutations relative to a naturally occurring A Subunit of a member of the Shiga toxin family which changes an enzymatic activity of the Shiga toxin A Subunit effector polypeptide, the mutation selected from at least one amino acid residue deletion, insertion, or substitution. For certain further embodiments, the mutation, relative to the naturally occurring A Subunit which changes an enzymatic activity of the Shiga toxin A Subunit effector polypeptide, reduces or eliminates a cytotoxicity exhibited by the Shiga toxin A Subunit effector polypeptide without the mutation(s).

Different embodiments of the cell-targeting molecules of the present invention are described below with reference to sets of embodiments numbered #1-20.

Embodiment Set #1—Cell-Targeting Molecules Comprising a De-Immunized Shiga Toxin Effector Polypeptide Comprising an Embedded or Inserted, Heterologous, T-Cell Epitope and a Non-Overlapping De-Immunized Sub-Region The present invention provides cell-targeting molecules, each comprising (i) a binding region capable of specifically binding an extracellular target biomolecule and (ii) a de-immunized, Shiga toxin effector polypeptide of Embodiment Set #1 (see e.g. FIG. 1, depicting illustrative examples of four, exemplary embodiments of the cell-targeting molecules of this embodiment set #1). For example, certain embodiments of set #1 is the cell-targeting molecule comprising (i) a binding region capable of specifically binding an extracellular target biomolecule and (ii) a de-immunized, Shiga toxin effector polypeptide comprising at least one inserted or embedded, heterologous epitope (a) and at least one disrupted, endogenous, B-cell and/or CD4+ T-cell epitope region (b), wherein the heterologous epitope does not overlap with the embedded or inserted, heterologous, T-cell epitope. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the heterologous, T-cell epitope is a CD8+ T-cell epitope, such as, e.g., with regard to a human immune system. For certain further embodiments, the heterologous, T-cell epitope is capable of being presented by a MHC class I molecule of a cell. In certain further embodiments, the cell-targeting molecule of the present invention is capable of one or more the following: entering a cell, inhibiting a ribosome function, causing cytostasis, causing cell death, and/or delivering the embedded or inserted, heterologous, T-cell epitope to a MHC class I molecule for presentation on a cellular surface. For certain further embodiments, the cell-targeting molecule is capable when introduced to cells of exhibiting a cytotoxicity comparable or better than a reference molecule, such as, e.g., a second cell-targeting molecule consisting of the cell-targeting molecule except for all of its Shiga toxin effector polypeptide component(s) each comprise a wild-type Shiga toxin A1 fragment.

For certain embodiments of Embodiment Set #1, the cell-targeting molecule comprises a molecular moiety located carboxy-terminal to the carboxy-terminus of the Shiga toxin A1 fragment region.

For certain embodiments of Embodiment Set #1, the cell-targeting molecule of the present invention is capable when introduced to a chordate of exhibiting improved in vivo tolerability and/or stability compared to a reference molecule, such as, e.g., a second cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy-terminus of its A1 fragment region. In certain further embodiments, the Shiga toxin effector polypeptide is not cytotoxic and the molecular moiety is cytotoxic.

In certain embodiments of Embodiment Set #1, the binding region and Shiga toxin effector polypeptide are linked together, either directly or indirectly.

In certain embodiments of Embodiment Set #1, the binding region comprises a polypeptide comprising an immunoglobulin-type binding region. In certain further embodiments, the binding region comprising a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain (affilin), Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality, such as, e.g., wherein the relative orientation or order of the heavy and light chains is reversed or flipped.

For certain embodiments of Embodiment Set #1, the cell-targeting molecule of the present invention is capable of exhibiting (i) a catalytic activity level comparable to a wild-type Shiga toxin A1 fragment or wild-type Shiga toxin effector polypeptide, (ii) a ribosome inhibition activity with a half-maximal inhibitory concentration ($IC_{50}$) value of 10,000 picomolar or less, and/or (iii) a significant level of Shiga toxin catalytic activity.

For certain embodiments of Embodiment Set #1, the cell-targeting molecule of the present invention and/or its Shiga toxin effector polypeptide is capable of exhibiting subcellular routing efficiency comparable to a reference cell-targeting molecule comprising a wild-type Shiga toxin A1 fragment or wild-type Shiga toxin effector polypeptide and/or capable of exhibiting a significant level of intracellular routing activity to the endoplasmic reticulum and/or cytosol from an endosomal starting location of a cell.

For certain embodiments of Embodiment Set #1, whereby administration of the cell-targeting molecule of the present invention to a cell physically coupled with the extracellular target biomolecule of the cell-targeting molecule's binding region, the cell-targeting molecule is capable of causing death of the cell. In certain further embodiments, administration of the cell-targeting molecule of the invention to two different populations of cell types which differ with respect to the presence or level of the extracellular target biomolecule, the cell-targeting molecule is capable of causing cell death to the cell-types physically coupled with an extracellular target biomolecule of the cytotoxic cell-targeting molecule's binding region at a $CD_{50}$ at least three times or less than the $CD_{50}$ to cell types which are not physically coupled with an extracellular target biomolecule of the cell-targeting molecule's binding region. For certain embodiments, whereby administration of the cell-targeting molecule of the present invention to a first populations of cells whose members are physically coupled to extracellular target biomolecules of the cell-targeting molecule's binding region, and a second population of cells whose members are not physically coupled to any extracellular target biomolecule of the binding region, the cytotoxic effect of the cell-targeting molecule to members of said first population of cells relative to members of said second population of cells is at least 3-fold greater. For certain embodiments, whereby administration of the cell-targeting molecule of the present invention to a first populations of cells whose members are physically coupled to a significant amount of the extracellular target biomolecule of the cell-targeting molecule's binding region, and a second population of cells whose members are not physically coupled to a significant amount of any extracellular target biomolecule of the binding region, the cytotoxic effect of the cell-targeting molecule to members of said first population of cells relative to members of said second population of cells is at least 3-fold greater. For certain embodiments, whereby administration of the cell-targeting molecule of the present invention to a first population of target biomolecule positive cells, and a second population of cells whose members do not express a significant amount of a target biomolecule of the cell-targeting molecule's binding region at a cellular surface, the cytotoxic effect of the cell-targeting molecule to members of the first population of cells relative to members of the second population of cells is at least 3-fold greater.

For certain embodiments of Embodiment Set #1, the cell-targeting molecule of the present invention is capable when introduced to cells of exhibiting a cytotoxicity with a half-maximal inhibitory concentration ($CD_{50}$) value of 300 nM or less and/or capable of exhibiting a significant level of Shiga toxin cytotoxicity.

For certain embodiments of Embodiment Set #1, the cell-targeting molecule of the present invention is capable of delivering an embedded or inserted, heterologous, CD8+ T-cell epitope to a MHC class I presentation pathway of a cell for cell-surface presentation of the epitope bound by a MHC class I molecule.

In certain embodiments of Embodiment Set #1, the cell-targeting molecule comprises a molecular moiety associated with the carboxy-terminus of the Shiga toxin effector polypeptide. In certain embodiments, the molecular moiety comprises or consists of the binding region. In certain embodiments, the molecular moiety comprises at least one amino acid and the Shiga toxin effector polypeptide is linked to at least one amino acid residue of the molecular moiety. In certain further embodiments, the molecular moiety and the Shiga toxin effector polypeptide are fused forming a continuous polypeptide.

In certain embodiments of Embodiment Set #1, the cell-targeting molecule further comprises a cytotoxic molecular moiety associated with the carboxy-terminus of the Shiga toxin effector polypeptide. For certain embodiments, the cytotoxic molecular moiety is a cytotoxic agent, such as, e.g., a small molecule chemotherapeutic agent, anti-neoplastic agent, cytotoxic antibiotic, alkylating agent, antimetabolite, topoisomerase inhibitor, and/or tubulin inhibitor known to the skilled worker and/or described herein. For certain further embodiments, the cytotoxic molecular moiety is cytotoxic at concentrations of less than 10,000, 5,000, 1,000, 500, or 200 pM.

In certain embodiments of Embodiment Set #1, the binding region is capable of binding to an extracellular target biomolecule selected from the group consisting of: CD20, CD22, CD40, CD74, CD79, CD25, CD30, HER2/neu/ErbB2, EGFR, EpCAM, EphB2, prostate-specific membrane antigen, Cripto, CDCP1, endoglin, fibroblast activated protein, Lewis-Y, CD19, CD21, CS1/SLAMF7, CD33, CD52, CD133, CEA, gpA33, mucin, TAG-72, tyrosine-protein kinase transmembrane receptor (ROR1 or NTRKR1), carbonic anhydrase IX, folate binding protein, ganglioside GD2, ganglioside GD3, ganglioside GM2, ganglioside Lewis-Y2, VEGFR, Alpha V beta3, Alpha5beta1, ErbB1/EGFR, Erb3, c-MET, IGF1R, EphA3, TRAIL-R1, TRAIL-R2, RANK, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, HPV-E7, Epstein-Barr virus antigen, Bcr-Abl, alpha-fetoprotein antigen, 17-A1, bladder tumor antigen, SAIL, CD38, CD15, CD23, CD45 (protein tyrosine phosphatase receptor type C), CD53, CD88, CD129, CD183, CD191, CD193, CD244, CD294, CD305, C3AR, FceRIa, galectin-9, IL-1R (interleukin-1 receptor), mrp-14, NKG2D ligand, programmed death-ligand 1 (PD-L1), Siglec-8, Siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC class I molecule, MHC class II molecule (optionally complexed with a peptide), CD284 (TLR4), CD107-Mac3, CD195 (CCR5), HLA-DR, CD16/32, CD282 (TLR2), CD11c, and any immunogenic fragment of any of the foregoing.

In certain embodiments of Embodiment Set #1, the binding region is linked, either directly or indirectly, to the Shiga toxin effector polypeptide by at least one covalent bond which is not a disulfide bond. In certain further embodiments, the binding region is fused, either directly or indirectly, to the carboxy-terminus of the Shiga toxin effector polypeptide to form a single, continuous polypeptide. In certain further embodiments, the binding region is an immunoglobulin-type binding region.

In certain embodiments of Embodiment Set #1, the disrupted furin-cleavage motif comprises one or more mutations in the minimal, furin-cleavage site relative to a wild-type Shiga toxin A Subunit. In certain embodiments, the disrupted furin-cleavage motif is not an amino-terminal truncation of sequences that overlap with part or all of at least one amino acid residue of the minimal furin-cleavage site. In certain embodiments, the mutation in the minimal, furin-cleavage site is an amino acid deletion, insertion, and/or substitution of at least one amino acid residue in the R/Y-x-x-R furin cleavage motif. In certain further embodiments, the disrupted furin-cleavage motif comprises at least one mutation relative to a wild-type Shiga toxin A Subunit, the mutation altering at least one amino acid residue in the region natively positioned 1) at 248-251 of the A Subunit of Shiga toxin (SEQ ID NOs: 1-2 and 4-6), or 2) at 247-250 of the A Subunit of Shiga-like toxin 2 (SEQ ID NOs: 3 and 7-18), or the equivalent amino acid sequence position in any Shiga toxin A Subunit. In certain further embodiments, the mutation is an amino acid residue substitution of an arginine residue with a non-positively charged, amino acid residue.

In certain embodiments of Embodiment Set #1, the cell-targeting molecule of the present invention is capable when introduced to cells of exhibiting cytotoxicity comparable to a cytotoxicity of a reference molecule, such as, e.g., a second cell-targeting molecule consisting of the cell-targeting molecule except for all of its Shiga toxin effector polypeptide component(s) each comprise a wild-type Shiga toxin A1 fragment.

In certain embodiments of Embodiment Set #1, the binding region comprises the peptide or polypeptide shown in any one of SEQ ID NOs: 39-245.

In certain embodiments of Embodiment Set #1, the cell-targeting molecule of the present invention comprises or consists essentially of the polypeptide shown in any one of SEQ ID NOs: 252-255 and 288-748, and optionally the cell-targeting molecule comprises an amino-terminal methionine residue.

In certain embodiments of Embodiment Set #1, the binding region sterically covers the carboxy-terminus of the A1 fragment region.

In certain embodiments of Embodiment Set #1, the molecular moiety sterically covers the carboxy-terminus of the A1 fragment region. In certain further embodiments, the molecular moiety comprises the binding region.

In certain embodiments of Embodiment Set #1, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Set #1, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #1, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

In certain embodiments of Embodiment Set #1, the amino-terminus of the Shiga toxin effector polypeptide is at and/or proximal to an amino-terminus of a polypeptide component of the cell-targeting molecule. In certain further embodiments, the binding region is not located proximally to the amino-terminus of the cell-targeting molecule relative to the Shiga toxin effector polypeptide. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. For certain further embodiments, the cell-targeting molecule of the present invention is capable when introduced to cells of exhibiting cytotoxicity that is greater than that of a third cell-targeting molecule having an amino-terminus and comprising the binding region and the Shiga toxin effector polypeptide which is not positioned at or proximal to the amino-terminus of the third cell-targeting molecule. For certain further embodiments, the cell-targeting molecule of the present invention exhibits cytotoxicity with better optimized, cytotoxic potency, such as, e.g., 4-fold, 5-fold, 6-fold, 9-fold, or greater cytotoxicity as compared to the cytotoxicity of the third cell-targeting molecule. For certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the third cell-targeting molecule to a second population of target positive cells as assayed by $CD_{50}$ values. In certain further embodiments, the third cell-targeting molecule does not comprise any carboxy-terminal, endoplasmic reticulum retention/retrieval signal motif of the KDEL family.

In certain embodiments of Embodiment Set #1, the amino-terminus of the Shiga toxin effector polypeptide is at and/or proximal to an amino-terminus of a polypeptide component of the cell-targeting molecule. In certain further embodiments, the binding region is not located proximally to the amino-terminus of the cell-targeting molecule relative to the Shiga toxin effector polypeptide. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. For certain further embodiments, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a third cell-targeting molecule having an amino-terminus and comprising the binding region and the Shiga toxin effector polypeptide which is not positioned at or proximal to the amino-terminus of the third cell-targeting molecule. In certain further embodiments, the third cell-targeting molecule does not comprise any carboxy-terminal, endoplasmic reticulum retention/retrieval signal motif of the KDEL family.

In certain embodiments of Embodiment Set #1, the amino-terminus of the Shiga toxin effector polypeptide is at and/or proximal to an amino-terminus of a polypeptide component of the cell-targeting molecule. In certain further embodiments, the binding region is not located proximally to the amino-terminus of the cell-targeting molecule relative to the Shiga toxin effector polypeptide. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. For certain further embodiments, the cell-targeting molecule of the present invention exhibits low cytotoxic potency (i.e. is not capable when introduced to certain positive target cell types of exhibiting a cytotoxicity greater than 1% cell death of a cell population at a cell-targeting molecule concentration of 1000 nM, 500 nM, 100 nM, 75 nM, or 50 nM) and is capable when introduced to cells of exhibiting a greater subcellular routing efficiency from an extracellular space to a subcellular compartment of an endoplasmic reticulum and/or cytosol as compared to the cytotoxicity of a third cell-targeting molecule having an amino-terminus and comprising the binding region and the Shiga toxin effector polypeptide which is not positioned at or proximal to the amino-terminus of the third cell-targeting molecule. In certain further embodiments, the third cell-targeting molecule does not comprise any carboxy-terminal, endoplasmic reticulum retention/retrieval signal motif of the KDEL family.

In certain embodiments of Embodiment Set #1, the cell-targeting molecule of the present invention, or a polypeptide component thereof, comprises a carboxy-terminal, endoplasmic reticulum retention/retrieval signal motif of a member of the KDEL family. For certain further embodiments, the carboxy-terminal endoplasmic reticulum retention/retrieval signal motif is selected from the group consisting of: KDEL, HDEF, HDEL, RDEF, RDEL, WDEL, YDEL, HEEF, HEEL, KEEL, REEL, KAEL, KCEL, KFEL, KGEL, KHEL, KLEL, KNEL, KQEL, KREL, KSEL, KVEL, KWEL, KYEL, KEDL, KIEL, DKEL, FDEL, KDEF, KKEL, HADL, HAEL, HIEL, HNEL, HTEL, KTEL, HVEL, NDEL, QDEL, REDL, RNEL, RTDL, RTEL, SDEL, TDEL, SKEL, STEL, and EDEL. In certain further embodiments, the cell-targeting molecule of the present invention is capable when introduced to cells of exhibiting cytotoxicity that is greater than that of a fourth cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to a reference molecule, such as, e.g., the fourth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the fourth cell-targeting molecule to a second population of target positive cells as assayed by $CD_{50}$ values.

Embodiment Set #2—Cell-Targeting Molecules Comprising a Carboxy-Terminal Endoplasmic Reticulum Retention/Retrieval Signal Motif and a Shiga Toxin Effector Polypeptide Comprising an Embedded or Inserted, Heterologous, T-Cell Epitope The present invention provides cell-targeting molecules, each comprising (i) a binding region capable of specifically binding an extracellular target biomolecule; (ii) a Shiga toxin effector polypeptide comprising an inserted or embedded, heterologous, epitope; and (iii) a carboxy-terminal, endoplasmic reticulum retention/retrieval signal motif. In certain embodiments, the cell-targeting molecule of the present invention comprises (a) a binding region capable of specifically binding at least one extracellular target biomolecule; (b) a Shiga toxin effector polypeptide comprising an embedded or inserted, heterologous epitope; and (c) a carboxy-terminal, endoplasmic reticulum retention/retrieval signal motif of a member of the KDEL family. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the heterologous, T-cell epitope is a CD8+ T-cell epitope, such as, e.g., with regard to a human immune system. For certain further embodiments, the heterologous, T-cell epitope is capable of being presented by a MHC class I molecule of a cell. In certain further embodiments, the cell-targeting molecule of the present invention is capable of one or more the following: entering a cell, inhibiting a ribosome function, causing cytostasis, causing cell death, and/or delivering the embedded or inserted, heterologous, T-cell epitope to a MHC class I molecule for presentation on a cellular surface.

In certain embodiments of Embodiment Set #2, the carboxy-terminal endoplasmic reticulum retention/retrieval signal motif is selected from the group consisting of: KDEL, HDEF, HDEL, RDEF, RDEL, WDEL, YDEL, HEEF, HEEL, KEEL, REEL, KAEL, KCEL, KFEL, KGEL, KHEL, KLEL, KNEL, KQEL, KREL, KSEL, KVEL, KWEL, KYEL, KEDL, KIEL, DKEL, FDEL, KDEF, KKEL, HADL, HAEL, HIEL, HNEL, HTEL, KTEL, HVEL, NDEL, QDEL, REDL, RNEL, RTDL, RTEL, SDEL, TDEL, SKEL, STEL, and EDEL.

In certain embodiments of Embodiment Set #2, the embedded or inserted, heterologous, T-cell epitope disrupts the endogenous, B-cell and/or T-cell epitope region selected from the group of natively positioned Shiga toxin A Subunit regions consisting of: (i) 1-15 of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; and 53-66 of any one of SEQ ID NOs: 1-18, or the equivalent region in a Shiga toxin A Subunit or derivative thereof; (ii) 94-115 of any one of SEQ ID NOs: 1-18; 141-153 of any one of SEQ ID NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18, or the equivalent region in a Shiga toxin A Subunit or derivative thereof; and (iii) 240-260 of any one of SEQ ID NOs: 3 and 7-18; 243-257 of any one of SEQ ID NOs: 1-2 and 4-6; 254-268 of any one of SEQ ID NOs: 1-2 and 4-6; 262-278 of any one of SEQ ID NOs: 3 and 7-18; 281-297 of any one of SEQ ID NOs: 3 and 7-18; and 285-293 of any one of SEQ ID NOs: 1-2 and 4-6, or the equivalent region in a Shiga toxin A Subunit or derivative thereof.

In certain further embodiments of Embodiment Set #2, the heterologous epitope is a CD8+ T-cell epitope capable of being presented by a MHC class I molecule of a cell. In certain further embodiments, the heterologous epitope in is embedded and replaces an equivalent number of amino acid residues in a wild-type Shiga toxin polypeptide region such that the Shiga toxin effector polypeptide has the same total number of amino acid residues as does the wild-type Shiga toxin polypeptide region from which it is derived. In certain further embodiments of any of the above, the Shiga toxin effector polypeptide is capable of exhibiting at least one Shiga toxin effector function selected from: directing intracellular routing to a cytosol of a cell in which the polypeptide is present, inhibiting a ribosome function, enzymatically inactivating a ribosome, and cytotoxicity.

In certain embodiments of Embodiment Set #2, the cell-targeting molecule of the present invention is capable when introduced to cells of exhibiting cytotoxicity that is greater than that of a fifth cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the fifth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the fifth cell-targeting molecule to a second population of target positive cells as assayed by $CD_{50}$ values.

For certain embodiments of Embodiment Set #2, the cell-targeting molecule of the present invention is capable of delivering an embedded or inserted, heterologous, CD8+ T-cell epitope to a MHC class I presentation pathway of a cell for cell-surface presentation of the epitope bound by a MHC class I molecule.

In certain embodiments of Embodiment Set #2, the cell-targeting molecule is de-immunized due to the embedded or inserted, heterologous, epitope. In certain further embodiments, the cell-targeting molecule is capable of exhibiting less relative antigenicity and/or relative immunogenicity as compared to a reference molecule, such as, e.g., a sixth cell-targeting molecule consisting of the cell-targeting molecule except for it lacks one or more embedded or inserted epitopes present in the cell targeting molecule.

For certain further embodiments of Embodiment Set #2, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the fifth cell-targeting molecule.

Embodiment Set #3—Cell-Targeting Molecules Comprising a Shiga Toxin Effector Polypeptide Comprising (i) an Embedded or Inserted, Heterologous, T-Cell Epitope and (ii) a Disrupted, Furin-Cleavage Motif The present invention provides cell-targeting molecules, each comprising (i) a binding region capable of specifically binding an extracellular target biomolecule; (ii) a Shiga toxin effector polypeptide comprising an inserted or embedded, heterologous, epitope; and (iii) a disrupted furin-cleavage motif. In certain embodiments, the cell-targeting molecule of the present invention comprises (i) a binding region capable of specifically binding an extracellular target biomolecule; (ii) a Shiga toxin effector polypeptide comprising (a) an inserted or embedded, heterologous, epitope; (b) a Shiga toxin A1 fragment derived region having a carboxy terminus; and (c) a disrupted furin-cleavage motif at the carboxy-terminus of the A1 fragment region. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the heterologous, T-cell epitope is a CD8+ T-cell epitope, such as, e.g., with regard to a human immune system. For certain further embodiments, the heterologous, T-cell epitope is capable of being presented by a MHC class I molecule of a cell. In certain further embodiments, the cell-targeting molecule of the present invention is capable of one or more the following: entering a cell, inhibiting a ribosome function, causing cytostasis, causing cell death, and/or delivering the embedded or inserted, heterologous, T-cell epitope to a MHC class I molecule for presentation on a cellular surface. For certain further embodiments, the cell-targeting molecule is capable when introduced to cells of exhibiting a cytotoxicity comparable or better than a reference molecule, such as, e.g., a second cell-targeting molecule consisting of the cell-targeting molecule except for all of its Shiga toxin effector polypeptide components comprise a wild-type Shiga toxin furin-cleavage site at the carboxy terminus of its A1 fragment region.

In certain embodiments of Embodiment Set #3, the embedded or inserted, heterologous, T-cell epitope disrupts the endogenous, B-cell and/or T-cell epitope region selected from the group of natively positioned Shiga toxin A Subunit regions consisting of: (i) 1-15 of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 4248 of any one of SEQ ID NOs: 3 and 7-18; and 53-66 of any one of SEQ ID NOs: 1-18, or the equivalent region in a Shiga toxin A Subunit or derivative thereof; (ii) 94-115 of any one of SEQ ID NOs: 1-18; 141-153 of any one of SEQ ID NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18, or the equivalent region in a Shiga toxin A Subunit or derivative thereof; and (iii) 240-260 of any one of SEQ ID NOs: 3 and 7-18; 243-257 of any one of SEQ ID NOs: 1-2 and 4-6; 254-268 of any one of SEQ ID NOs: 1-2 and 4-6; 262-278 of any one of SEQ ID NOs: 3 and 7-18; 281-297 of any one of SEQ ID NOs: 3 and 7-18; and 285-293 of any one of SEQ ID NOs: 1-2 and 4-6, or the equivalent region in a Shiga toxin A Subunit or derivative thereof.

In certain embodiments of Embodiment Set #3, the disrupted furin-cleavage motif comprises one or more mutations, relative to a wild-type Shiga toxin A Subunit, the mutation altering at least one amino acid residue in a region natively positioned at 248-251 of the A Subunit of Shiga toxin (SEQ ID NOs: 1-2 and 4-6), or at 247-250 of the A Subunit of Shiga-like toxin 2 (SEQ ID NOs: 3 and 7-18); or the equivalent region in a Shiga toxin A Subunit or derivative thereof. In certain further embodiments, the disrupted furin-cleavage motif comprises one or more mutations, relative to a wild-type Shiga toxin A Subunit, in a minimal furin cleavage site of the furin-cleavage motif. In certain further embodiments the minimal furin cleavage site is represented by the consensus amino acid sequence R/Y-x-x-R and/or R-x-x-R.

In certain embodiments of Embodiment Set #3, the cell-targeting molecule comprises a molecular moiety located carboxy-terminal to the carboxy-terminus of the Shiga toxin A1 fragment region.

In certain embodiments of Embodiment Set #3, the binding region sterically covers the carboxy-terminus of the A1 fragment region.

In certain embodiments of Embodiment Set #3, the molecular moiety sterically covers the carboxy-terminus of the A1 fragment region. In certain further embodiments, the molecular moiety comprises the binding region.

In certain embodiments of Embodiment Set #3, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Set #3, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #3, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

In certain embodiments of Embodiment Set #3, the disrupted furin-cleavage motif comprises an amino acid residue substitution in the furin-cleavage motif relative to a wild-type Shiga toxin A Subunit. In certain further embodiments, the substitution of the amino acid residue in the furin-cleavage motif is of an arginine residue with a non-positively charged, amino acid residue selected from the group consisting of: alanine, glycine, proline, serine, threonine, aspartate, asparagine, glutamate, glutamine, cysteine, isoleucine, leucine, methionine, valine, phenylalanine, tryptophan, and tyrosine. In certain embodiments, the substitution of the amino acid residue in the furin-cleavage motif is of an arginine residue with a histidine.

In certain embodiments of Embodiment Set #3, the cell-targeting molecule is capable when introduced to cells of exhibiting cytotoxicity comparable to the cytotoxicity of a seventh cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region. In certain further embodiments, the cell-targeting molecule of the present invention is capable when introduced to cells of exhibiting cytotoxicity that is in a range of from 0.1-fold, 0.5-fold, or 0.75-fold to 1.2-fold, 1.5-fold, 1.75-fold, 2-fold, 3-fold, 4-fold, or 5-fold of the cytotoxicity exhibited by the seventh cell-targeting molecule.

In certain embodiments of Embodiment Set #3, the cell-targeting molecule is capable when introduced to a chordate of exhibiting improved, in vivo tolerability compared to in vivo tolerability of the seventh cell-targeting molecule.

In certain embodiments of Embodiment Set #3, the cell-targeting molecule is de-immunized due to the embedded or inserted, heterologous, epitope. In certain further embodiments, the cell-targeting molecule is capable of exhibiting less relative antigenicity and/or relative immunogenicity as compared to a reference molecule, such as, e.g., an eighth cell-targeting molecule consisting of the cell-targeting molecule except for it lacks one or more embedded or inserted epitopes present in the cell targeting molecule.

In certain embodiments of Embodiment Set #3, the cell-targeting molecule is de-immunized due to the furin-cleavage motif disruption. In certain further embodiments, the cell-targeting molecule is capable of exhibiting less relative antigenicity and/or relative immunogenicity as compared to a ninth cell-targeting molecule consisting of the cell-targeting molecule except for the furin-cleavage motif is wild-type and/or all the Shiga toxin effector polypeptide components consist of a wild-type Shiga toxin A1 fragment.

Embodiment Set #4—Cell-Targeting Molecules Comprising a Shiga Toxin Effector Polypeptide at or Proximal to an Amino-Terminus and Wherein the Shiga Toxin Effector Polypeptide Comprises an Embedded or Inserted, Heterologous, T-Cell Epitope The present invention provides cell-targeting molecules, each comprising (i) a binding region capable of specifically binding an extracellular target biomolecule; (ii) a Shiga toxin effector polypeptide comprising an inserted or embedded, heterologous, epitope; wherein the Shiga toxin effector polypeptide is at or proximal to an amino-terminus of a polypeptide. In certain embodiments, the cell-targeting molecule of the present invention comprises (i) a binding region capable of specifically binding an extracellular target biomolecule, (ii) a polypeptide component, and (iii) a Shiga toxin effector polypeptide comprising an inserted or embedded, heterologous, epitope; wherein the Shiga toxin effector polypeptide is at or proximal to an amino-terminus of the polypeptide component of the cell-targeting molecule. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. In certain further embodiments, the binding region is not located proximally to an amino-terminus of the cell-targeting molecule relative to the Shiga toxin effector polypeptide. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the heterologous, T-cell epitope is a CD8+ T-cell epitope, such as, e.g., with regard to a human immune system. For certain further embodiments, the heterologous, T-cell epitope is capable of being presented by a MHC class I molecule of a cell. In certain further embodiments, the cell-targeting molecule of the present invention is capable of one or more the following: entering a cell, inhibiting a ribosome function, causing cytostasis, causing cell death, and/or delivering the embedded or inserted, heterologous, T-cell epitope to a MHC class I molecule for presentation on a cellular surface.

In certain embodiments of Embodiment Set #4, the cell-targeting molecule of the present invention is capable when introduced to cells of exhibiting cytotoxicity that is greater than that of a tenth cell-targeting molecule having an amino-terminus and comprising the binding region and the Shiga toxin effector polypeptide region which is not positioned at or proximal to the amino-terminus of the tenth cell-targeting molecule. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the tenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the tenth cell-targeting molecule to a second population of target positive cells as assayed by $CD_{50}$ values.

For certain embodiments of Embodiment Set #4, the cell-targeting molecule of the present invention is capable of delivering an embedded or inserted, heterologous, CD8+ T-cell epitope to a MHC class T presentation pathway of a cell for cell-surface presentation of the epitope bound by a MHC class I molecule.

In certain embodiments of Embodiment Set #4, the cell-targeting molecule is de-immunized due to the embedded or inserted, heterologous, epitope. In certain further embodiments, the cell-targeting molecule is capable of exhibiting less relative antigenicity and/or relative immunogenicity as compared to a reference molecule, such as, e.g., an eleventh cell-targeting molecule consisting of the cell-targeting molecule except for it lacks one or more embedded or inserted epitopes present in the cell targeting molecule.

For certain further embodiments of Embodiment Set #4, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the tenth cell-targeting molecule.

Embodiment Set #5—Cell-Targeting Molecules Comprising a De-Immunized Shiga Toxin Effector Polypeptide Comprising a Disrupted, Furin-Cleavage Motif The present invention provides cell-targeting molecules, each comprising (i) a binding region capable of specifically binding an extracellular target biomolecule and (ii) a de-immunized, Shiga toxin effector polypeptide comprising a disrupted furin-cleavage motif. In certain embodiments, the cell-targeting molecule of the present invention comprises (i) a binding region capable of specifically binding an extracellular target biomolecule and (ii) a de-immunized, Shiga toxin effector polypeptide comprising (a) a Shiga toxin A1 fragment derived region having a carboxy terminus, (b) a disrupted furin-cleavage motif at the carboxy-terminus of the A1 fragment region, and (c) at least one disrupted, endogenous, B-cell and/or CD4+ T-cell epitope and/or epitope region. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death. For certain further embodiments, the cell-targeting molecule is capable when introduced to cells of exhibiting a cytotoxicity comparable or better than a reference molecule, such as, e.g., a second cell-targeting molecule consisting of the cell-targeting molecule except for all of its Shiga toxin effector polypeptide components comprise a wild-type Shiga toxin furin-cleavage site at the carboxy terminus of its A1 fragment region.

In certain embodiments of Embodiment Set #5, the Shiga toxin effector polypeptide comprises a mutation, relative to a wild-type Shiga toxin A Subunit, in the B-cell and/or T-cell epitope region selected from the group of natively positioned Shiga toxin A Subunit regions consisting of: 1-15 of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; and 53-66 of any one of SEQ ID NOs: 1-18; 94-115 of any one of SEQ ID NOs: 1-18; 141-153 of any one of SEQ ID NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18; 240-260 of any one of SEQ ID NOs: 3 and 7-18; 243-257 of any one of SEQ ID NOs: 1-2 and 4-6; 254-268 of any one of SEQ ID NOs: 1-2 and 4-6; 262-278 of any one of SEQ ID NOs: 3 and 7-18; 281-297 of any one of SEQ ID NOs: 3 and 7-18; and 285-293 of any one of SEQ ID NOs: 1-2 and 4-6; or the equivalent region in a Shiga toxin A Subunit or derivative thereof. In certain further embodiments, there is no disruption which is a carboxy-terminal truncation of amino acid residues that overlap with part or all of at least one disrupted, endogenous, B-cell and/or T-cell epitope and/or epitope region.

In certain embodiments of Embodiment Set #5, the disrupted furin-cleavage motif comprises one or more mutations, relative to a wild-type Shiga toxin A Subunit, the mutation altering at least one amino acid residue in a region natively positioned at 248-251 of the A Subunit of Shiga toxin (SEQ ID NOs: 1-2 and 4-6), or at 247-250 of the A Subunit of Shiga-like toxin 2 (SEQ ID NOs: 3 and 7-18), or the equivalent region in a Shiga toxin A Subunit or derivative thereof. In certain further embodiments, the disrupted furin-cleavage motif comprises one or more mutations, relative to a wild-type Shiga toxin A Subunit, in a minimal furin cleavage site of the furin-cleavage motif. In certain further embodiments the minimal furin cleavage site is represented by the consensus amino acid sequence R/Y-x-x-R and/or R-x-x-R.

In certain embodiments of Embodiment Set #5, the cell-targeting molecule comprises a molecular moiety located carboxy-terminal to the carboxy-terminus of the Shiga toxin A1 fragment region.

In certain embodiments of Embodiment Set #5, the binding region sterically covers the carboxy-terminus of the A1 fragment region.

In certain embodiments of Embodiment Set #5, the molecular moiety sterically covers the carboxy-terminus of the A1 fragment region. In certain further embodiments, the molecular moiety comprises the binding region.

In certain embodiments of Embodiment Set #5, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Set #5, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #5, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

In certain embodiments of Embodiment Set #5, the disrupted furin-cleavage motif comprises an amino acid residue substitution in the furin-cleavage motif relative to a wild-type Shiga toxin A Subunit. In certain further embodiments, the substitution of the amino acid residue in the furin-cleavage motif is of an arginine residue with a non-positively charged, amino acid residue selected from the group consisting of: alanine, glycine, proline, serine, threonine, aspartate, asparagine, glutamate, glutamine, cysteine, isoleucine, leucine, methionine, valine, phenylalanine, tryptophan, and tyrosine. In certain embodiments, the substitution of the amino acid residue in the furin-cleavage motif is of an arginine residue with a histidine.

In certain embodiments of Embodiment Set #5, the cell-targeting molecule is capable when introduced to cells of exhibiting cytotoxicity comparable to the cytotoxicity of a reference molecule, such as, e.g., a twelfth cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region. In certain further embodiments, the cell-targeting molecule of the present invention is capable when introduced to cells of exhibiting cytotoxicity that is in a range of from 0.1-fold, 0.5-fold, or 0.75-fold to 1.2-fold, 1.5-fold, 1.75-fold, 2-fold, 3-fold, 4-fold, or 5-fold of the cytotoxicity exhibited by the twelfth cell-targeting molecule.

In certain embodiments of Embodiment Set #4, the cell-targeting molecule is capable when introduced to a chordate of exhibiting improved, in vivo tolerability compared to in vivo tolerability of the twelfth cell-targeting molecule.

In certain embodiments of Embodiment Set #4, the cell-targeting molecule is de-immunized due to the furin-cleavage motif disruption. In certain further embodiments, the cell-targeting molecule is capable of exhibiting less relative antigenicity and/or relative immunogenicity as compared to a reference cell-targeting molecule consisting of the cell-targeting molecule except for the furin-cleavage motif is wild-type and/or all the Shiga toxin effector polypeptide components consist of a wild-type Shiga toxin A1 fragment, such as, e.g., the twelfth cell-targeting molecule.

In certain embodiments of Embodiment Set #4, the cell-targeting molecule of the present invention comprises or consists essentially of the polypeptide shown in any one of SEQ ID NOs: 252-255, 259-271, 274-278 and 288-748, and optionally the cell-targeting molecule comprises an amino-terminal methionine residue.

Embodiment Set #6—Cell-Targeting Molecules Comprising a Carboxy-Terminal Endoplasmic Reticulum Retention/Retrieval Signal Motif and a De-Immunized Shiga Toxin Effector Polypeptide The present invention provides cell-targeting molecules, each comprising (i) a binding region capable of specifically binding an extracellular target biomolecule; (ii) a de-immunized, Shiga toxin effector polypeptide, and (iii) a carboxy-terminal, endoplasmic reticulum retention/retrieval signal motif. In certain embodiments, the cell-targeting molecule of the present invention comprises (i) a binding region capable of specifically binding an extracellular target biomolecule; (ii) a de-immunized, Shiga toxin effector polypeptide comprising at least one disrupted, endogenous, B-cell and/or CD4+ T-cell epitope and/or epitope region, and (iii) a carboxy-terminal, endoplasmic reticulum retention/retrieval signal motif of a member of the KDEL family. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death.

In certain embodiments of Embodiment Set #6, the carboxy-terminal endoplasmic reticulum retention/retrieval signal motif is selected from the group consisting of; KDEL, HDEF, HDEL, RDEF, RDEL, WDEL, YDEL, HEEF, HEEL, KEEL, REEL, KAEL, KCEL, KFEL, KGEL, KHEL, KLEL, KNEL, KQEL, KREL, KSEL, KVEL, KWEL, KYEL, KEDL, KIEL, DKEL, FDEL, KDEF, KKEL, HADL, HAEL, HIEL, HNEL, HTEL, KTEL, HVEL, NDEL, QDEL, REDL, RNEL, RTDL, RTEL, SDEL, TDEL, SKEL, STEL, and EDEL.

In certain embodiments of Embodiment Set #6, the Shiga toxin effector polypeptide comprises a mutation, relative to a wild-type Shiga toxin A Subunit, in the B-cell and/or T-cell epitope region selected from the group of natively positioned Shiga toxin A Subunit regions consisting of: 1-15 of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; and 53-66 of any one of SEQ ID NOs: 1-18; 94-115 of any one of SEQ ID NOs: 1-18; 141-153 of any one of SEQ TD NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18; 240-260 of any one of SEQ ID NOs: 3 and 7-18; 243-257 of any one of SEQ ID NOs: 1-2 and 4-6; 254-268 of any one of SEQ ID NOs: 1-2 and 4-6; 262-278 of any one of SEQ ID NOs: 3 and 7-18; 281-297 of any one of SEQ ID NOs: 3 and 7-18; and 285-293 of any one of SEQ ID NOs: 1-2 and 4-6; or the equivalent region in a Shiga toxin A Subunit or derivative thereof. In certain further embodiments, there is no disruption which is a carboxy-terminal truncation of amino acid residues that overlap with part or all of at least one disrupted, endogenous, B-cell and/or T-cell epitope and/or epitope region.

In certain embodiments of Embodiment Set #6, the cell-targeting molecule of the present invention is capable when introduced to cells of exhibiting cytotoxicity that is greater than that of a thirteenth cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the thirteenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the thirteenth cell-targeting molecule to a second population of target positive cells as assayed by $CD_{50}$ values.

For certain further embodiments of Embodiment Set #6, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the thirteenth cell-targeting molecule.

Embodiment Set #7—Cell-Targeting Molecules Comprising a De-Immunized Shiga Toxin Effector Polypeptide at or Proximal to an Amino-Terminus of the Cell Targeting Molecule The present invention provides cell-targeting molecules, each comprising (i) a binding region capable of specifically binding an extracellular target biomolecule, (ii) a de-immunized, Shiga toxin effector polypeptide; wherein the Shiga toxin effector polypeptide is at or proximal to an amino-terminus. In certain embodiments, the cell-targeting molecule of the present invention comprises (i) a binding region capable of specifically binding an extracellular target biomolecule; (ii) polypeptide component; and (iii) a de-immunized, Shiga toxin effector polypeptide comprising at least one disrupted, endogenous, B-cell and/or CD4+ T-cell epitope and/or epitope region; wherein the Shiga toxin effector polypeptide is at or proximal to an amino-terminus of the polypeptide component of the cell-targeting molecule. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. In certain further embodiments, the binding region is not located proximally to an amino-terminus of the cell-targeting molecule relative to the Shiga toxin effector polypeptide. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death.

In certain embodiments of Embodiment Set #7, the Shiga toxin effector polypeptide comprises a mutation, relative to a wild-type Shiga toxin A Subunit, in the B-cell and/or T-cell epitope region selected from the group of natively positioned Shiga toxin A Subunit regions consisting of: 11-15 of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; and 53-66 of any one of SEQ TD NOs: 1-18; 94-115 of any one of SEQ ID NOs: 1-18; 141-153 of any one of SEQ ID NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18; 240-260 of any one of SEQ ID NOs: 3 and 7-18; 243-257 of any one of SEQ ID NOs: 1-2 and 4-6; 254-268 of any one of SEQ ID NOs: 1-2 and 4-6; 262-278 of any one of SEQ ID NOs: 3 and 7-18; 281-297 of any one of SEQ ID NOs: 3 and 7-18; and 285-293 of any one of SEQ ID NOs: 1-2 and 4-6; or the equivalent region in a Shiga toxin A Subunit or derivative thereof. In certain further embodiments, there is no disruption which is a carboxy-terminal truncation of amino acid residues that overlap with part or all of at least one disrupted, endogenous, B-cell and/or T-cell epitope and/or epitope region.

In certain embodiments of Embodiment Set #7, the cell-targeting molecule of the present invention is capable when introduced to cells of exhibiting cytotoxicity that is greater than that of a fourteenth cell-targeting molecule having an amino-terminus and comprising the binding region and the Shiga toxin effector polypeptide region which is not positioned at or proximal to the amino-terminus of the fourteenth cell-targeting molecule. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the fourteenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the fourteenth cell-targeting molecule to a second population of target positive cells as assayed by $CD_{50}$ values.

For certain further embodiments of Embodiment Set #7, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the fourteenth cell-targeting molecule.

In certain embodiments of Embodiment Set #7, the cell-targeting molecule of the present invention comprises or consists essentially of the polypeptide shown in any one of SEQ ID NOs: 252-255, 259-271, 274-278 and 288-748, and optionally the cell-targeting molecule comprises an amino-terminal methionine residue.

Embodiment Set #8—Cell-Targeting Molecules Comprising a Carboxy-Terminal Endoplasmic Reticulum Retention/Retrieval Signal Motif and a Shiga Toxin Effector Polypeptide Comprising a Disrupted, Furin-Cleavage Motif The present invention provides cell-targeting molecules, each comprising (i) a binding region capable of specifically binding an extracellular target biomolecule; (ii) a Shiga toxin effector polypeptide comprising a disrupted furin-cleavage motif; and (iii) a carboxy-terminal endoplasmic reticulum retention/retrieval signal motif. The present invention provides cell-targeting molecules, each comprising (i) a binding region capable of specifically binding an extracellular target biomolecule; (ii) a Shiga toxin effector polypeptide comprising a disrupted furin-cleavage motif; and (iii) a carboxy-terminal, endoplasmic reticulum retention/retrieval signal motif of a member of the KDEL family. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death. For certain further embodiments, the cell-targeting molecule is capable when introduced to cells of exhibiting a cytotoxicity comparable or better than a reference molecule, such as, e.g., a second cell-targeting molecule consisting of the cell-targeting molecule except for all of its Shiga toxin effector polypeptide components comprise a wild-type Shiga toxin furin-cleavage site at the carboxy terminus of its A1 fragment region.

In certain embodiments of Embodiment Set #8, the disrupted furin-cleavage motif comprises one or more mutations, relative to a wild-type Shiga toxin A Subunit, the mutation altering at least one amino acid residue in a region natively positioned at 248-251 of the A Subunit of Shiga toxin (SEQ ID NOs: 1-2 and 4-6), or at 247-250 of the A Subunit of Shiga-like toxin 2 (SEQ ID NOs: 3 and 7-18), or the equivalent region in a Shiga toxin A Subunit or derivative thereof. In certain further embodiments, the disrupted furin-cleavage motif comprises one or more mutations, relative to a wild-type Shiga toxin A Subunit, in a minimal furin cleavage site of the furin-cleavage motif. In certain further embodiments the minimal furin cleavage site is represented by the consensus amino acid sequence R/Y-x-x-R and/or R-x-x-R.

In certain embodiments of Embodiment Set #8, the cell-targeting molecule comprises a molecular moiety located carboxy-terminal to the carboxy-terminus of the Shiga toxin A1 fragment region.

In certain embodiments of Embodiment Set #8, the binding region sterically covers the carboxy-terminus of the A1 fragment region.

In certain embodiments of Embodiment Set #8, the molecular moiety sterically covers the carboxy-terminus of the A1 fragment region. In certain further embodiments, the molecular moiety comprises the binding region.

In certain embodiments of Embodiment Set #8, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Set #8, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #8, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

In certain embodiments of Embodiment Set #8, the disrupted furin-cleavage motif comprises an amino acid residue substitution in the furin-cleavage motif relative to a wild-type Shiga toxin A Subunit. In certain further embodiments, the substitution of the amino acid residue in the furin-cleavage motif is of an arginine residue with a non-positively charged, amino acid residue selected from the group consisting of: alanine, glycine, proline, serine, threonine, aspartate, asparagine, glutamate, glutamine, cysteine, isoleucine, leucine, methionine, valine, phenylalanine, tryptophan, and tyrosine. In certain embodiments, the substitution of the amino acid residue in the furin-cleavage motif is of an arginine residue with a histidine.

In certain embodiments of Embodiment Set #8, the cell-targeting molecule of the present invention is capable when introduced to cells of exhibiting cytotoxicity that is greater than that of a fifteenth cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the fifteenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the fifteenth cell-targeting molecule to a second population of target positive cells as assayed by $CD_{50}$ values.

In certain embodiments of Embodiment Set #8, the cell-targeting molecule is capable when introduced to a chordate of exhibiting improved, in vivo tolerability compared to in vivo tolerability of a sixteenth cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region.

In certain embodiments of Embodiment Set #8, the cell-targeting molecule is de-immunized due to the furin-cleavage motif disruption. In certain further embodiments, the cell-targeting molecule is capable of exhibiting less relative antigenicity and/or relative immunogenicity as compared to a reference cell-targeting molecule consisting of the cell-targeting molecule except for the furin-cleavage motif is wild-type and/or all the Shiga toxin effector polypeptide components consist of a wild-type Shiga toxin A1 fragment, such as, e.g., the sixteenth cell-targeting molecule.

For certain further embodiments of Embodiment Set #8, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the fifteenth cell-targeting molecule.

Embodiment Set #9—Cell-Targeting Molecules Comprising a Furin-Cleavage Resistant Shiga Toxin Effector Polypeptide at or Proximal to an Amino-Terminus of the Cell Targeting Molecule The present invention provides cell-targeting molecules, each comprising (i) a binding region capable of specifically binding an extracellular target biomolecule and (ii) a Shiga toxin effector polypeptide comprising a disrupted furin-cleavage motif at the carboxy-terminus of its Shiga toxin A1 fragment region; wherein the amino-terminus of the Shiga toxin effector polypeptide is at and/or proximal to an amino-terminus of a polypeptide component of the cell-targeting molecule. In certain embodiments, the cell-targeting molecule of the present invention comprises (i) a binding region capable of specifically binding an extracellular target biomolecule, (ii) a Shiga toxin effector polypeptide having an amino-terminus and a Shiga toxin A1 fragment derived region having a carboxy terminus, and (iii) a disrupted furin-cleavage motif at the carboxy-terminus of the A1 fragment region; wherein the binding region is not located proximally to the amino-terminus of the cell-targeting molecule relative to the Shiga toxin effector polypeptide. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. In certain further embodiments, the binding region is not located proximally to an amino-terminus of the cell-targeting molecule relative to the Shiga toxin effector polypeptide. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death. For certain further embodiments, the cell-targeting molecule is capable when introduced to cells of exhibiting a cytotoxicity comparable or better than a reference molecule, such as, e.g., a seventeenth cell-targeting molecule consisting of the cell-targeting molecule except for all of its Shiga toxin effector polypeptide components comprise a wild-type Shiga toxin furin-cleavage site at the carboxy terminus of its A1 fragment region.

In certain embodiments of Embodiment Set #9, the disrupted furin-cleavage motif comprises one or more mutations, relative to a wild-type Shiga toxin A Subunit, the mutation altering at least one amino acid residue in a region natively positioned at 248-251 of the A Subunit of Shiga toxin (SEQ ID NOs: 1-2 and 4-6), or at 247-250 of the A Subunit of Shiga-like toxin 2 (SEQ ID NOs: 3 and 7-18), or the equivalent region in a Shiga toxin A Subunit or derivative thereof. In certain further embodiments, the disrupted furin-cleavage motif comprises one or more mutations, relative to a wild-type Shiga toxin A Subunit, in a minimal furin cleavage site of the furin-cleavage motif. In certain further embodiments the minimal furin cleavage site is represented by the consensus amino acid sequence R/Y-x-x-R and/or R-x-x-R.

In certain embodiments of Embodiment Set #9, the cell-targeting molecule comprises a molecular moiety located carboxy-terminal to the carboxy-terminus of the Shiga toxin A1 fragment region.

In certain embodiments of Embodiment Set #9, the binding region sterically covers the carboxy-terminus of the A1 fragment region.

In certain embodiments of Embodiment Set #9, the molecular moiety sterically covers the carboxy-terminus of the A1 fragment region. In certain further embodiments, the molecular moiety comprises the binding region.

In certain embodiments of Embodiment Set #9, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Set #9, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #9, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

In certain embodiments of Embodiment Set #9, the disrupted furin-cleavage motif comprises an amino acid residue substitution in the furin-cleavage motif relative to a wild-type Shiga toxin A Subunit. In certain further embodiments, the substitution of the amino acid residue in the furin-cleavage motif is of an arginine residue with a non-positively charged, amino acid residue selected from the group consisting of: alanine, glycine, proline, serine, threonine, aspartate, asparagine, glutamate, glutamine, cysteine, isoleucine, leucine, methionine, valine, phenylalanine, tryptophan, and tyrosine. In certain embodiments, the substitution of the amino acid residue in the furin-cleavage motif is of an arginine residue with a histidine.

In certain embodiments of Embodiment Set #9, the cell-targeting molecule of the present invention is capable when introduced to cells of exhibiting cytotoxicity that is greater than that of an eighteenth cell-targeting molecule having an amino-terminus and comprising the binding region and the Shiga toxin effector polypeptide region which is not positioned at or proximal to the amino-terminus of the eighteenth cell-targeting molecule. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the eighteenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the eighteenth cell-targeting molecule to a second population of target positive cells as assayed by $CD_{50}$ values.

In certain embodiments of Embodiment Set #9, the cell-targeting molecule is capable when introduced to a chordate of exhibiting improved, in vivo tolerability compared to in vivo tolerability of a nineteenth cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region.

In certain embodiments of Embodiment Set #9, the cell-targeting molecule is de-immunized due to the furin-cleavage motif disruption. In certain further embodiments, the cell-targeting molecule is capable of exhibiting less relative antigenicity and/or relative immunogenicity as compared to a reference cell-targeting molecule consisting of the cell-targeting molecule except for the furin-cleavage motif is wild-type and/or all the Shiga toxin effector polypeptide components consist of a wild-type Shiga toxin A1 fragment, such as, e.g., the nineteenth cell-targeting molecule.

For certain further embodiments of Embodiment Set #9, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the nineteenth cell-targeting molecule.

In certain embodiments of Embodiment Set #9, the cell-targeting molecule of the present invention comprises or consists essentially of the polypeptide shown in any one of SEQ ID NOs: 252-255, 259-271, 274-278 and 288-748, and optionally the cell-targeting molecule comprises an amino-terminal methionine residue.

Embodiment Set #10—Cell-Targeting Molecules Comprising a Carboxy-Terminal Endoplasmic Reticulum Retention/Retrieval Signal Motif and Shiga Toxin Effector Polypeptide at or Proximal to an Amino-Terminus of the Cell Targeting Molecule The present invention provides cell-targeting molecules, each comprising (i) a binding region capable of specifically binding an extracellular target biomolecule, (ii) a carboxy-terminal, endoplasmic reticulum retention/retrieval signal motif, and (iii) a Shiga toxin effector polypeptide; wherein the amino-terminus of the Shiga toxin effector polypeptide is at and/or proximal to an amino-terminus of a polypeptide component of the cell-targeting molecule. In certain embodiments, the cell-targeting molecule of the present invention comprises a (i) binding region capable of specifically binding an extracellular target biomolecule, (ii) a carboxy-terminal, endoplasmic reticulum retention/retrieval signal motif of a member of the KDEL family, (iii) a polypeptide component, and (iv) a Shiga toxin effector polypeptide; wherein the amino-terminus of the Shiga toxin effector polypeptide is at and/or proximal to an amino-terminus of a polypeptide component of the cell-targeting molecule. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. In certain further embodiments, the binding region is not located proximally to an amino-terminus of the cell-targeting molecule relative to the Shiga toxin effector polypeptide.

For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death.

In certain embodiments of Embodiment Set #10, the carboxy-terminal endoplasmic reticulum retention/retrieval signal motif is selected from the group consisting of: KDEL, HDEF, HDEL, RDEF, RDEL, WDEL, YDEL, HEEF, HEEL, KEEL, REEL, KAEL, KCEL, KFEL, KGEL, KHEL, KLEL, KNEL, KQEL, KREL, KSEL, KVEL, KWEL, KYEL, KEDL, KIEL, DKEL, FDEL, KDEF, KKEL, HADL, HAEL, HIEL, HNEL, HTEL, KTEL, HVEL, NDEL, QDEL, REDL, RNEL, RTDL, RTEL, SDEL, TDEL, SKEL, STEL, and EDEL.

In certain embodiments of Embodiment Set #10, the cell-targeting molecule of the present invention is capable when introduced to cells of exhibiting cytotoxicity that is greater than that of a twentieth cell-targeting molecule having an amino-terminus and comprising the binding region and the Shiga toxin effector polypeptide region which is not positioned at or proximal to the amino-terminus of the twentieth cell-targeting molecule and/or greater than that of a twenty-first cell-targeting molecule consisting of the cell-targeting molecule except for it does not comprise any carboxy-terminal, endoplasmic reticulum retention/retrieval signal motif of the KDEL family. In certain further embodiments, the twentieth cell-targeting molecule does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to a reference molecule, such as, e.g., the twentieth and/or twenty-first cell-targeting molecules. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the twentieth and/or twenty-first cell-targeting molecules to a second population of target positive cells as assayed by $CD_{50}$ values.

For certain further embodiments of Embodiment Set #10, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the twentieth and/or twenty-first cell-targeting molecules.

Multivalent Cell-Targeting Molecules of the Present Invention

In certain embodiments, the cell-targeting molecule of the present invention is multivalent. In certain embodiments, the multivalent cell-targeting molecule of the present invention comprises two or more binding regions, wherein each binding region is capable of specifically binding an extracellular part of the same extracellular target biomolecule. For certain further embodiments, upon administration of the multivalent cell-targeting molecule to a population of cells physically coupled with target biomolecule, which have the extracellular part bound by two or more binding regions of the multivalent cell-targeting molecule, results in a cytotoxic effect which is greater than a cytotoxic effect resulting from administration of an equivalent amount, mass, or molarity of a monovalent target-binding molecule component of the multivalent cell-targeting molecule to a population of the same target-positive cells under same conditions by a factor of 2, 2.5, 3, 4, 5, 7.5, 10, or greater than the fold-change in target-binding between the monovalent target-binding molecule component and the multivalent cell-targeting molecule as measured by dissociation constant ($K_D$).

Embodiment Set #11—Multivalent Cell-Targeting Molecules Comprising a De-Immunized Shiga Toxin Effector Polypeptide Comprising an Embedded or Inserted, Heterologous, T-Cell Epitope and a Non-Overlapping De-Immunized Sub-Region The present invention provides multivalent cell-targeting molecules comprising (i) two or more binding regions, each capable of specifically binding an extracellular part of the same target biomolecule, and (ii) at least one de-immunized, Shiga toxin effector polypeptide. For example, certain Embodiments of Set #11 is the multivalent cell-targeting molecule comprising (i) two or more binding regions each of which is capable of specifically binding the same extracellular target biomolecule and (ii) at least one, de-immunized, Shiga toxin effector polypeptide comprising at least one inserted or embedded, heterologous epitope (a) and at least one disrupted, endogenous, B-cell and/or CD4+ T-cell epitope region (b), wherein the heterologous epitope does not overlap with the embedded or inserted, heterologous, T-cell epitope. For certain further embodiments, the at least one, de-immunized, Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. For certain further embodiments, upon administration of the multivalent cell-targeting molecule to a plurality of cells physically coupled with an extracellular target biomolecule of the two or more binding regions, which have the extracellular part bound by two or more binding regions, at a concentration of multivalent cell-targeting molecule equivalent to five percent, ten percent, twenty percent, thirty-five percent, fifty percent, sixty-five percent, seventy-five percent, and/or eighty percent cell-surface occupancy, the majority of the multivalent cell-targeting molecule internalizes into the plurality of cells in about fifteen hours, ten hours, five hours, four hours, three hours, two hours, one hour, thirty minutes, or less at a physiological temperature appropriate for the cell and/or at about 37 degrees Celsius. In certain further embodiments, the heterologous, T-cell epitope is a CD8+ T-cell epitope, such as, e.g., with regard to a human immune system. For certain further embodiments, the heterologous, T-cell epitope is capable of being presented by a MHC class I molecule of a cell. For certain further embodiments, the multivalent cell-targeting molecule of the present invention is capable of one or more the following: entering a cell, inhibiting a ribosome function, causing cytostasis, causing caspase activation, causing cell death, and/or delivering the embedded or inserted, heterologous, T-cell epitope to a MHC class I molecule for presentation on a cellular surface. For certain further embodiments, the multivalent cell-targeting molecule is capable when introduced to cells of exhibiting a cytotoxicity comparable or greater than the cytotoxicity of a reference molecule introduced to the same type of cells. Non-limiting examples of references molecules include a second cell-targeting molecule, such as, e.g., (1) a monovalent second cell-targeting molecule comprising only one of the two or more binding regions of the multivalent cell-targeting molecule of interest and one or more of the same Shiga toxin effector polypeptide component(s) of the multivalent cell-targeting molecule, and/or (2) a multivalent third cell-targeting molecule consisting of the multivalent cell-targeting molecule except for all of its Shiga toxin effector polypeptide component(s) each comprises a wild-type Shiga toxin A1 fragment.

Each of the at least one, de-immunized, Shiga toxin effector polypeptides has an amino terminus, whether with regard to a polypeptide regional boundary and/or a physical polypeptide terminus.

In certain embodiments, the at least one, de-immunized, Shiga toxin effector polypeptide comprises a Shiga toxin A1 fragment region and/or Shiga toxin A1 fragment derived region having a carboxy-terminus. In certain embodiments, the at least one, de-immunized, Shiga toxin effector polypeptide comprises a Shiga toxin A1 fragment region and/or Shiga toxin A1 fragment derived region having a carboxy-terminus. In certain further embodiments, all of the Shiga toxin effector polypeptide components of the multivalent cell-targeting molecule each comprises a Shiga toxin A1 fragment region and/or Shiga toxin A1 fragment derived region having a carboxy-terminus.

In certain embodiments of Embodiment Set #11, the multivalent cell-targeting molecule comprises a molecular moiety located carboxy-terminal to the carboxy-terminus of the Shiga toxin A1 fragment region and/or Shiga toxin A1 fragment derived region of at least one, de-immunized, Shiga toxin effector polypeptide.

For certain embodiments of Embodiment Set #11, the multivalent cell-targeting molecule of the present invention is capable when introduced to a chordate of exhibiting improved in vivo tolerability and/or stability compared to a reference molecule, such as, e.g., a fourth cell-targeting molecule consisting of the multivalent cell-targeting molecule except for at least one of the fourth cell-targeting molecule's Shiga toxin effector polypeptide component(s) comprises a wild-type Shiga toxin A1 fragment and/or wild-type Shiga toxin furin-cleavage site at the carboxy terminus of its A1 fragment region or Shiga toxin A1 fragment derived region. For certain further embodiments, (1) all the de-immunized, Shiga toxin effector polypeptide(s) located amino-terminal to a molecular moiety is not cytotoxic and (2) the molecular moiety is cytotoxic.

In certain embodiments of Embodiment Set #11, at least one of the two or more binding regions and the at least one, de-immunized, Shiga toxin effector polypeptide are linked together, either directly or indirectly, such as, e.g., being fused to form a continuous polypeptide (see e.g. FIG. 1). In certain further embodiments, all of the two or more binding regions are each linked, either directly or indirectly, to a de-immunized Shiga toxin effector polypeptide component of the multivalent cell-targeting molecule (see e.g. FIG. 1).

In certain further embodiments, all the two or more binding regions and all the de-immunized, Shiga toxin effector polypeptides are linked together, either directly or indirectly, such as, e.g., being fused to form a continuous polypeptide (see e.g. FIG. 1).

In certain embodiments of Embodiment Set #11, at least one of the two or more binding regions comprises a polypeptide comprising an immunoglobulin-type binding region. In certain further embodiments, at least one of the two or more binding regions comprises a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality. In certain embodiments, each of the two or more binding regions of the multivalent cell-targeting molecule comprises a polypeptide comprising an immunoglobulin-type binding region and/or a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality.

In certain embodiments, the multivalent cell-targeting molecule of the present invention comprises two or more proteinaceous components (e.g. protein subunits), wherein each proteinaceous component comprises (a) at least one of the two or more binding regions, and, optionally, (b) one or more of the at least one, de-immunized, Shiga toxin effector polypeptide. In certain further embodiments, each proteinaceous component comprises (1) only one of the two or more binding regions and (2) only one, de-immunized, Shiga toxin effector polypeptide. In certain further embodiments, the multivalent cell-targeting molecule of the present invention comprises exactly two proteinaceous components.

In certain embodiments, the multivalent cell-targeting molecule of the present invention comprises two or more components, wherein at least one component is associated with the multivalent cell-targeting molecule through one or more non-covalent interactions. In certain further embodiments, at least one of the components is proteinaceous. In certain further embodiments, the multivalent cell-targeting molecule of the present invention comprises two or more proteinaceous components associated with each other, either directly or indirectly, through one or more non-covalent interactions. In certain further embodiments, each proteinaceous component comprises (1) at least one of the two or more binding regions and (2) at least one of the at least one, de-immunized, Shiga toxin effector polypeptide.

In certain embodiments, the multivalent cell-targeting molecule of the present invention comprises two or more Shiga toxin effector polypeptides, whether de-immunized or not de-immunized. In certain embodiments, the multivalent cell-targeting molecule of the present invention comprises two or more proteinaceous components (e.g. protein subunits), wherein each proteinaceous component comprises (a) at least one of the two or more binding regions, and, optionally, (b) one or more Shiga toxin effector polypeptides. In certain further embodiments, each proteinaceous component comprises (1) only one of the two or more binding regions and (2) only one Shiga toxin effector polypeptide. In certain further embodiments, the multivalent cell-targeting molecule of the present invention comprises two or more components (e.g. a proteinaceous component), wherein at least one component is associated with the multivalent cell-targeting molecule through one or more non-covalent interactions. In certain further embodiments, each proteinaceous component comprises (1) at least one of the two or more binding regions and (2) at least one Shiga toxin effector polypeptide.

In certain embodiments, a Shiga toxin effector polypeptide component of the multivalent cell-targeting molecule of the present invention comprises a Shiga toxin A1 fragment region and/or Shiga toxin A1 fragment derived region having a carboxy-terminus. In certain further embodiments, all of the Shiga toxin effector polypeptide components of the multivalent cell-targeting molecule each comprises a Shiga toxin A1 fragment region and/or Shiga toxin A1 fragment derived region having a carboxy-terminus.

For certain embodiments of Embodiment Set #11, the multivalent cell-targeting molecule of the present invention is capable of exhibiting (i) a catalytic activity level comparable to a wild-type Shiga toxin A1 fragment or wild-type Shiga toxin effector polypeptide, (ii) a ribosome inhibition activity with a half-maximal inhibitory concentration ($IC_{50}$) value of 10,000 picomolar or less, and/or (iii) a significant level of Shiga toxin catalytic activity.

For certain embodiments of Embodiment Set #11, the multivalent cell-targeting molecule of the present invention and/or its at least one, de-immunized, Shiga toxin effector polypeptide is capable of exhibiting subcellular routing efficiency comparable to a reference cell-targeting molecule comprising a wild-type Shiga toxin A1 fragment or wild-type Shiga toxin effector polypeptide and/or capable of exhibiting a significant level of intracellular routing activity to the endoplasmic reticulum and/or cytosol from an endosomal starting location of a cell.

For certain embodiments of Embodiment Set #11, whereby administration of the multivalent cell-targeting molecule of the present invention to a cell physically coupled with extracellular target biomolecule of the multivalent cell-targeting molecule's two or more binding regions, the multivalent cell-targeting molecule is capable of causing death of the cell. For certain further embodiments, administration of the multivalent cell-targeting molecule of the invention to two different populations of cell types which differ with respect to the presence or level of physically coupled extracellular target biomolecule, the multivalent cell-targeting molecule is capable of causing cell death to the cell-types physically coupled with an extracellular target biomolecule of the multivalent cell-targeting molecule's two or more binding regions at a $CD_{50}$ at least three times or less than the $CD_{50}$ to cell types which are not physically coupled with an extracellular target biomolecule of the multivalent cell-targeting molecule's two or more binding regions. For certain embodiments, whereby administration of the multivalent cell-targeting molecule of the present invention to a first population of cells whose members are physically coupled to extracellular target biomolecules of the multivalent cell-targeting molecule's two or more binding regions, and a second population of cells whose members are not physically coupled to any extracellular target biomolecule of the two or more binding regions, the cytotoxic effect of the multivalent cell-targeting molecule to members of said first population of cells relative to members of said second population of cells is at least 3-fold greater. For certain embodiments, whereby administration of the multivalent cell-targeting molecule of the present invention to a first population of cells whose members are physically coupled to a significant amount of the extracellular target biomolecule of the multivalent cell-targeting molecule's two or more binding regions, and a second population of cells whose members are not physically coupled to a significant amount of any extracellular target biomolecule of the two or more binding regions, the cytotoxic effect of the multivalent cell-targeting molecule to members of said first population of cells relative to members of said second population of cells is at least 3-fold greater. For certain embodiments, whereby administration of the multivalent cell-targeting molecule of the present invention to a first population of target biomolecule positive cells, and a second population of cells whose members do not express a significant amount of a target biomolecule of the multivalent cell-targeting molecule's two or more binding regions at a cellular surface, the cytotoxic effect of the multivalent cell-targeting molecule to members of the first population of cells relative to members of the second population of cells is at least 3-fold greater.

For certain embodiments of Embodiment Set #11, the multivalent cell-targeting molecule of the present invention is capable when introduced to cells of exhibiting a cytotoxicity with a half-maximal inhibitory concentration ($CD_{50}$) value of 300 nanomolar (nM) or less and/or capable of exhibiting a significant level of Shiga toxin cytotoxicity.

For certain embodiments of Embodiment Set #11, the multivalent cell-targeting molecule of the present invention is capable of delivering an embedded or inserted, heterologous, CD8+ T-cell epitope to a MHC class I presentation pathway of a cell for cell-surface presentation of the epitope bound by a MHC class I molecule.

In certain embodiments of Embodiment Set #11, the multivalent cell-targeting molecule comprises a molecular moiety associated with the carboxy-terminus of the at least one, de-immunized, Shiga toxin effector polypeptide. In certain embodiments, the molecular moiety comprises or consists of the one or more the two or more binding regions. In certain embodiments, the molecular moiety comprises at least one amino acid and the at least one, de-immunized, Shiga toxin effector polypeptide is linked, either directly or indirectly, to at least one amino acid residue of the molecular moiety. In certain further embodiments, the molecular moiety and the at least one, de-immunized, Shiga toxin effector polypeptide are fused, either directly or indirectly, forming a continuous polypeptide. In certain further embodiments, the molecular moiety(ies) is each fused to the at least one, de-immunized, Shiga toxin effector polypeptide, either directly or indirectly, to form a continuous polypeptide.

In certain embodiments of Embodiment Set #11, the multivalent cell-targeting molecule further comprises a cytotoxic molecular moiety associated with the carboxy-terminus of the at least one, de-immunized, Shiga toxin effector polypeptide. In certain embodiments, the cytotoxic molecular moiety is a cytotoxic agent, such as, e.g., a small molecule chemotherapeutic agent, anti-neoplastic agent, cytotoxic antibiotic, cytotoxic anti-infective, alkylating agent, antimetabolite, topoisomerase inhibitor, and/or tubulin inhibitor known to the skilled worker and/or described herein. In certain further embodiments, the cytotoxic molecular moiety is cytotoxic at concentrations of less than 10,000, 5,000, 1,000, 500, or 200 picomolar (pM).

For certain embodiments of Embodiment Set #11, the two or more binding regions are each capable of binding to an extracellular target biomolecule selected from the group consisting of: CD20, CD22, CD40, CD74, CD79, CD25, CD30, HER2/neu/ErbB2, EGFR, EpCAM, EphB2, prostate-specific membrane antigen, Cripto, CDCP1, endoglin, fibroblast activated protein, Lewis-Y, CD19, CD21, CS1/SLAMF7, CD33, CD52, CD133, CEA, gpA33, mucin, TAG-72, tyrosine-protein kinase transmembrane receptor (ROR1 or NTRKR1), carbonic anhydrase IX, folate binding protein, ganglioside GD2, ganglioside GD3, ganglioside GM2, ganglioside Lewis-Y2, VEGFR, Alpha V beta3, Alpha5beta1, ErbB1/EGFR, Erb3, c-MET, IGF1R, EphA3, TRAIL-R1, TRAIL-R2, RANK, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, HPV-E7, Epstein-Barr virus antigen, Bcr-Abl, alpha-fetoprotein antigen, 17-A1, bladder tumor antigen, SAIL, CD38, CD15, CD23, CD45 (protein tyrosine phosphatase receptor type C), CD53, CD88, CD129, CD183, CD191, CD193, CD244, CD294, CD305, C3AR, FceRIa, galectin-9, IL-1R (interleukin-1 receptor), mrp-14, NKG2D ligand, programmed death-ligand 1 (PD-L1), Siglec-8, Siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC class I molecule, MHC class II molecule (optionally complexed with a peptide), CD284 (TLR4), CD107-Mac3, CD195 (CCR5), HLA-DR, CD16/32, CD282 (TLR2), CD11c, and any immunogenic fragment of any of the foregoing.

In certain embodiments of Embodiment Set #11, one or more of the two or more binding regions is linked, either directly or indirectly, to at least one of the at least one, de-immunized, Shiga toxin effector polypeptide by at least one covalent bond which is not a disulfide bond. In certain further embodiments, one or more of the multivalent cell-targeting molecule's two or more binding regions is fused, either directly or indirectly, to the carboxy-terminus of the at least one, de-immunized, Shiga toxin effector polypeptide to form a single, continuous polypeptide. In certain further embodiments, at least one of the two or more binding regions comprises an immunoglobulin-type binding region. In certain further embodiments, all of the multivalent cell-targeting molecule's two or more binding regions each comprises an immunoglobulin-type binding region.

In certain embodiments of Embodiment Set #11, the disrupted furin-cleavage motif comprises one or more mutations in the minimal, furin-cleavage site relative to a wild-type Shiga toxin A Subunit. In certain embodiments, the disrupted furin-cleavage motif is not an amino-terminal truncation of sequences that overlap with part or all of at least one amino acid residue of the minimal furin-cleavage site. In certain embodiments, the mutation in the minimal, furin-cleavage site is an amino acid deletion, insertion, and/or substitution of at least one amino acid residue in the R/Y-x-x-R furin cleavage motif. In certain further embodiments, the disrupted furin-cleavage motif comprises at least one mutation relative to a wild-type Shiga toxin A Subunit, the mutation altering at least one amino acid residue in the region natively positioned at 248-251 of the A Subunit of Shiga toxin (SEQ ID NOs: 1-2 and 4-6), or at 247-250 of the A Subunit of Shiga-like toxin 2 (SEQ ID NOs: 3 and 7-18), or the equivalent amino acid sequence position in any Shiga toxin A Subunit. In certain further embodiments, the mutation is an amino acid residue substitution of an arginine residue with a non-positively charged, amino acid residue.

In certain embodiments of Embodiment Set #11, at least one of the two or more binding regions comprises the peptide or polypeptide shown in any one of SEQ ID NOs: 39-245.

In certain embodiments of Embodiment Set #11, the multivalent cell-targeting molecule of the present invention comprises the polypeptide shown in any one of SEQ ID NOs: 252-255 and 288-748. In certain further embodiments, the multivalent cell-targeting molecule of the present invention comprises or consists essentially of two proteins, each protein selected from any one of the polypeptides shown in SEQ ID NOs: 252-255 and 288-748, and optionally, each protein further comprises an amino-terminal methionine residue.

In certain embodiments of Embodiment Set #11, at least one of the two or more binding regions sterically covers the carboxy-terminus of the A1 fragment region or Shiga toxin A1 fragment derived region of at least one of the at least one, de-immunized, Shiga toxin effector polypeptide(s). In certain further embodiments, the at least one of the two or more binding regions sterically cover the carboxy-terminals of the A1 fragment region or A1 fragment derived region of all the Shiga toxin effector polypeptide component(s) present in the multivalent cell-targeting molecule. In certain further embodiments, each of the carboxy-terminals of the A1 fragment region or A1 fragment derived region of each of the Shiga toxin effector polypeptide components present in the multivalent cell-targeting molecule is sterically covered by at least one of the two or more binding regions.

In certain embodiments of Embodiment Set #11, the molecular moiety sterically covers the carboxy-terminus of the A1 fragment region and/or Shiga toxin A1 fragment derived region of at least one of the at least one, de-immunized, Shiga toxin effector polypeptide(s). In certain further embodiments, the molecular moiety comprises at least one of the two or more binding regions.

In certain embodiments of Embodiment Set #11, the molecular moiety sterically covers the carboxy-terminus of the A1 fragment region and/or Shiga toxin A1 fragment derived region of at least one of the at least one, de-immunized, Shiga toxin effector polypeptide(s). In certain further embodiments, the molecular moiety(ies) sterically cover the carboxy-terminals of the A1 fragment region or A1 fragment derived region of all the Shiga toxin effector polypeptide component(s) present in the multivalent cell-targeting molecule. In certain further embodiments, each of the carboxy-terminals of the A1 fragment region or A1 fragment derived region of each of the Shiga toxin effector polypeptide components present in the multivalent cell-targeting molecule is sterically covered by at least one of the molecular moiety(ies). In certain further embodiments, each of the molecular moieties present in the multivalent cell-targeting molecule comprises at least one of the two or more binding regions.

In certain embodiments of Embodiment Set #11, the multivalent cell-targeting molecule of the present invention comprises at least one of the two or more binding regions and/or molecular moiety located carboxy-terminal to the carboxy-terminus of the Shiga toxin A1 fragment region and/or Shiga toxin A1 fragment derived region of the at least one, de-immunized, Shiga toxin effector polypeptide. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater. In certain embodiments, the multivalent cell-targeting molecule of the present invention comprises the two or more binding regions and/or the molecular moiety located within the multivalent cell-targeting molecule at a position carboxy-terminal to the carboxy-terminus of the Shiga toxin A1 fragment region and/or Shiga toxin A1 fragment derived region of the at least one, de-immunized, Shiga toxin effector polypeptide.

In certain embodiments of Embodiment Set #11, the multivalent cell-targeting molecule comprises the binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the multivalent cell-targeting molecule retains the appropriate level of the Shiga toxin biological activity noted herein (e.g., cytotoxicity, intracellular routing, and/or cellular internalization kinetic parameter(s)). In certain embodiments of Embodiment Set #11, the two or more binding regions have a combined mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the multivalent cell-targeting molecule retains the appropriate level of the Shiga toxin biological activity noted herein (e.g., cytotoxicity, intracellular routing, and/or cellular internalization kinetic parameter(s)). In certain further embodiments, each of the two or more binding regions of the multivalent cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the multivalent cell-targeting molecule retains the appropriate level of the Shiga toxin biological activity noted herein (e.g., cytotoxicity, intracellular routing, and/or cellular internalization kinetics parameter(s)).

In certain embodiments of Embodiment Set #11, at least one of the two or more binding regions is comprised within a relatively large, molecular moiety such as, e.g., the molecular moiety having a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the multivalent cell-targeting molecule retains the appropriate level of the Shiga toxin biological activity noted herein.

In certain embodiments of Embodiment Set #11, at least one, de-immunized, Shiga toxin effector polypeptide is more proximal to an amino-terminus of a polypeptide component of the multivalent cell-targeting molecule relative to any of the two or more binding regions. In certain further embodiments, none of the two or more binding regions comprised within the same polypeptide chain of a component of the multivalent cell-targeting molecule comprising at least one, de-immunized, Shiga toxin effector polypeptide, are located proximal to an amino-terminus of that polypeptide chain relative to at least one, de-immunized, Shiga toxin effector polypeptide comprised within that polypeptide chain. In certain embodiments, the amino-terminus of at least one, de-immunized, Shiga toxin effector polypeptide is at and/or proximal to an amino-terminus of a polypeptide component of the multivalent cell-targeting molecule. In certain further embodiments, the amino-terminus of all the Shiga toxin effector polypeptides present in the multivalent cell-targeting molecule is at and/or proximal to an amino-terminus of a polypeptide component of the multivalent cell-targeting molecule. In certain further embodiments, the two or more binding regions and the least one, de-immunized, Shiga toxin effector polypeptide are physically arranged or oriented within the multivalent cell-targeting molecule such that none of the two or more binding regions are located proximal to the amino-terminus of at least one, de-immunized, Shiga toxin effector polypeptide relative to that Shiga toxin effector polypeptide component's carboxy-terminus. In certain further embodiments, none of the two or more binding regions are located proximal to any amino-terminus of the multivalent cell-targeting molecule relative to at least one Shiga toxin effector polypeptide component. In certain embodiments, the two or more binding regions are linked within the multivalent cell-targeting molecule more proximal to the carboxy-terminus of the at least one, de-immunized, Shiga toxin effector polypeptide than to the amino-terminus of that de-immunized, Shiga toxin effector polypeptide. In certain embodiments, all the de-immunized, Shiga toxin effector polypeptide components are more proximal to an amino-terminus of a polypeptide component of the multivalent cell-targeting molecule relative to any of the two or more binding regions comprised within the same polypeptide chain of that polypeptide component. In certain further embodiments, the two or more binding regions and the least one, de-immunized, Shiga toxin effector polypeptide are physically arranged or oriented within the multivalent cell-targeting molecule such that none of the two or more binding regions are located proximal to the amino-terminus of any de-immunized, Shiga toxin effector polypeptide component relative to that Shiga toxin effector polypeptide component's carboxy-terminus. In certain embodiments, all the Shiga toxin effector polypeptide components are more proximal to an amino-terminus of a polypeptide component of the multivalent cell-targeting molecule relative to any of the two or more binding regions comprised within the same polypeptide chain of that polypeptide component. In certain further embodiments, the two or more binding regions are physically arranged or oriented within the multivalent cell-targeting molecule such that none of the two or more binding regions are located proximal to the amino-terminus of any Shiga toxin effector polypeptide component relative to that Shiga toxin effector polypeptide component's carboxy-terminus. For certain further embodiments, the multivalent cell-targeting molecule of the present invention is capable when introduced to cells of exhibiting cytotoxicity that is greater than that of a reference molecule, such as, e.g., a fifth cell-targeting molecule comprising a polypeptide component having an amino-terminus and comprising the same two or more binding regions and the same de-immunized, Shiga toxin effector polypeptide(s) which is not positioned at or proximal to a physical amino-terminus of a polypeptide component of the fifth cell-targeting molecule or a sixth cell-targeting molecule comprising the same two or more binding regions and the same Shiga toxin effector polypeptide component(s) as the multivalent cell-targeting molecule wherein at least one of the two or more binding regions is more proximal to an amino-terminus of a polypeptide component of the multivalent cell-targeting molecule relative to all the Shiga toxin effector polypeptide components. For certain further embodiments, the cell-targeting molecule of the present invention exhibits cytotoxicity with better optimized, cytotoxic potency, such as, e.g., 4-fold, 5-fold, 6-fold, 9-fold, or greater cytotoxicity as compared to the cytotoxicity of the fourth cell-targeting molecule. For certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the fifth and/or sixth cell-targeting molecule to a second population of target positive cells as assayed by $CD_{50}$ values. In certain further embodiments, the multivalent cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the subcellular routing efficiency of the fifth and/or sixth cell-targeting molecule. In certain further embodiments, the fifth and/or sixth cell-targeting molecule does not comprise any carboxy-terminal, endoplasmic reticulum retention/retrieval signal motif of the KDEL family.

In certain embodiments of Embodiment Set #11, the amino-terminus of the at least one, de-immunized, Shiga toxin effector polypeptide is at and/or proximal to an amino-terminus of a polypeptide component of the multivalent cell-targeting molecule. In certain further embodiments, the amino-terminus of all the Shiga toxin effector polypeptides present in the multivalent cell-targeting molecule is at and/or proximal to an amino-terminus of a polypeptide component of the multivalent cell-targeting molecule. In certain further embodiments, the at least one, de-immunized, Shiga toxin effector polypeptide is more proximal to an amino-terminus of a polypeptide component of the multivalent cell-targeting molecule relative to any of the two or more binding regions. In certain further embodiments, none of the two or more binding regions comprised within the same polypeptide chain of a polypeptide component of the multivalent cell-targeting molecule comprising at least one, de-immunized, Shiga toxin effector polypeptide, are located proximal to an amino-terminus of that polypeptide chain relative to at least one, de-immunized, Shiga toxin effector polypeptide comprised within that polypeptide chain. In certain further embodiments, the two or more binding regions and the least one, de-immunized, Shiga toxin effector polypeptide are physically arranged or oriented within the multivalent cell-targeting molecule such that none of the two or more binding regions are located proximal to the amino-terminus of at least one, de-immunized, Shiga toxin effector polypeptide relative to that Shiga toxin effector polypeptide component's carboxy-terminus. In certain further embodiments, none of the two or more binding regions are located proximal to any amino-terminus of the multivalent cell-targeting molecule relative to at least one Shiga toxin effector polypeptide component. In certain embodiments, the two or more binding regions are linked within the multivalent cell-targeting molecule more proximal to the carboxy-terminus of the at least one, de-immunized, Shiga toxin effector polypeptide than to the amino-terminus of that de-immunized, Shiga toxin effector polypeptide. In certain further embodiments, none of the two or more binding regions are located proximal to any amino-terminus of the multivalent cell-targeting molecule relative to at least one Shiga toxin effector polypeptide component. In certain further embodiments, the two or more binding regions are linked within the multivalent cell-targeting molecule more proximal to the carboxy-terminus of the at least one Shiga toxin effector polypeptide than to the amino-terminus of that Shiga toxin effector polypeptide. In certain embodiments, all the de-immunized, Shiga toxin effector polypeptide components are more proximal to an amino-terminus of a polypeptide component of the multivalent cell-targeting molecule relative to any of the two or more binding regions comprised within the same polypeptide chain of that polypeptide component. In certain further embodiments, the two or more binding regions and the least one, de-immunized, Shiga toxin effector polypeptide are physically arranged or oriented within the multivalent cell-targeting molecule such that none of the two or more binding regions are located proximal to the amino-terminus of any de-immunized, Shiga toxin effector polypeptide component relative to that Shiga toxin effector polypeptide component's carboxy-terminus. In certain embodiments, all the Shiga toxin effector polypeptide components are more proximal to an amino-terminus of a polypeptide component of the multivalent cell-targeting molecule relative to any of the two or more binding regions comprised within the same polypeptide chain of that polypeptide component. In certain further embodiments, the two or more binding regions are physically arranged or oriented within the multivalent cell-targeting molecule such that none of the two or more binding regions are located proximal to the amino-terminus of any Shiga toxin effector polypeptide component relative to that Shiga toxin effector polypeptide component's carboxy-terminus. For certain embodiments, the cell-targeting molecule of the present invention exhibits cytotoxicity with better optimized, cytotoxic potency, such as, e.g., 4-fold, 5-fold, 6-fold, 9-fold, or greater cytotoxicity as compared to the cytotoxicity of a reference molecule, such as, e.g., a seventh multivalent cell-targeting molecule having an amino-terminus and comprising the same two or more binding regions and the same Shiga toxin effector polypeptide component(s) as the multivalent cell-targeting molecule wherein none of the Shiga toxin effector polypeptide components is at and/or proximal to an amino-terminus of a polypeptide component of the multivalent cell-targeting molecule. For certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the seventh cell-targeting molecule to a second population of target positive cells as assayed by $CD_{50}$ values. In certain further embodiments, the multivalent cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the subcellular routing efficiency of the seventh cell-targeting molecule. In certain further embodiments, the seventh cell-targeting molecule does not comprise any carboxy-terminal, endoplasmic reticulum retention/retrieval signal motif of the KDEL family.

In certain embodiments of Embodiment Set #11, the two or more binding regions are not located proximal to an amino-terminus of a polypeptide component of the multivalent cell-targeting molecule relative to at least one, de-immunized, Shiga toxin effector polypeptide. In certain further embodiments, the two or more binding regions and Shiga toxin effector polypeptide are physically arranged or oriented within the multivalent cell-targeting molecule such that the two or more binding region are not located proximal to the amino-terminus of at least one, de-immunized, Shiga toxin effector polypeptide. In certain further embodiments, none of the two or more binding regions comprised within the same polypeptide chain of a component of the multivalent cell-targeting molecule comprising at least one, de-immunized, Shiga toxin effector polypeptide, are located proximal to an amino-terminus of that polypeptide chain relative to at least one, de-immunized, Shiga toxin effector polypeptide comprised within that polypeptide chain. In certain further embodiments, the amino-terminus of at least one, de-immunized, Shiga toxin effector polypeptide is at and/or proximal to an amino-terminus of a polypeptide component of the multivalent cell-targeting molecule. In certain further embodiments, the amino-terminus of all the Shiga toxin effector polypeptides present in the multivalent cell-targeting molecule is at and/or proximal to an amino-terminus of a polypeptide component of the multivalent cell-targeting molecule. In certain further embodiments, the two or more binding regions and the least one, de-immunized, Shiga toxin effector polypeptide are physically arranged or oriented within the multivalent cell-targeting molecule such that none of the two or more binding regions are located proximal to the amino-terminus of at least one, de-immunized, Shiga toxin effector polypeptide relative to that Shiga toxin effector polypeptide component's carboxy-terminus. In certain further embodiments, none of the two or more binding regions are located proximal to any amino-terminus of the multivalent cell-targeting molecule relative to at least one Shiga toxin effector polypeptide component. In certain embodiments, the two or more binding regions are linked within the multivalent cell-targeting molecule more proximal to the carboxy-terminus of the at least one, de-immunized, Shiga toxin effector polypeptide than to the amino-terminus of that de-immunized, Shiga toxin effector polypeptide. In certain embodiments, all the de-immunized, Shiga toxin effector polypeptide components are more proximal to an amino-terminus of a polypeptide component of the multivalent cell-targeting molecule relative to any of the two or more binding regions comprised within the same polypeptide chain of that polypeptide component. In certain further embodiments, the two or more binding regions and the least one, de-immunized, Shiga toxin effector polypeptide are physically arranged or oriented within the multivalent cell-targeting molecule such that none of the two or more binding regions are located proximal to the amino-terminus of any de-immunized, Shiga toxin effector polypeptide component relative to that Shiga toxin effector polypeptide component's carboxy-terminus. In certain embodiments, all the Shiga toxin effector polypeptide components are more proximal to an amino-terminus of a polypeptide component of the multivalent cell-targeting molecule relative to any of the two or more binding regions comprised within the same polypeptide chain of that polypeptide component. In certain further embodiments, the two or more binding regions are physically arranged or oriented within the multivalent cell-targeting molecule such that none of the two or more binding regions are located proximal to the amino-terminus of any Shiga toxin effector polypeptide component relative to that Shiga toxin effector polypeptide component's carboxy-terminus. For certain embodiments, the cell-targeting molecule of the present invention exhibits cytotoxicity with better optimized, cytotoxic potency, such as, e.g., 4-fold, 5-fold, 6-fold, 9-fold, or greater cytotoxicity as compared to the cytotoxicity of a reference molecule, such as, e.g., an eighth multivalent cell-targeting molecule having polypeptide component having an amino-terminus and comprising the same two or more binding regions and the same Shiga toxin effector polypeptide component(s) as the multivalent cell-targeting molecule wherein at least one of the two or more binding regions is located proximal to an amino-terminus of a polypeptide component of the multivalent cell-targeting molecule relative to each of all the Shiga toxin effector polypeptide component(s). In certain further embodiments, the multivalent cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the subcellular routing efficiency of the eighth cell-targeting molecule. In certain further embodiments, the eighth cell-targeting molecule does not comprise any carboxy-terminal, endoplasmic reticulum retention/retrieval signal motif of the KDEL family.

In certain embodiments of Embodiment Set #11, the multivalent cell-targeting molecule of the present invention, and/or a polypeptide component thereof, comprises a carboxy-terminal, endoplasmic reticulum retention/retrieval signal motif of a member of the KDEL family. In certain further embodiments, the carboxy-terminal endoplasmic reticulum retention/retrieval signal motif is selected from the group consisting of: KDEL, HDEF, HDEL, RDEF, RDEL, WDEL, YDEL, HEEF, HEEL, KEEL, REEL, KAEL, KCEL, KFEL, KGEL, KHEL, KLEL, KNEL, KQEL, KREL, KSEL, KVEL, KWEL, KYEL, KEDL, KIEL, DKEL, FDEL, KDEF, KKEL, HADL, HAEL, HIEL, HNEL, HTEL, KTEL, HVEL, NDEL, QDEL, REDL, RNEL, RTDL, RTEL, SDEL, TDEL, SKEL, STEL, and EDEL. In certain further embodiments, the multivalent cell-targeting molecule of the present invention is capable when introduced to cells of exhibiting cytotoxicity that is greater than that of a reference molecule, such as, e.g., a ninth cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to a reference molecule, such as, e.g., the ninth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the ninth cell-targeting molecule to a second population of target positive cells as assayed by $CD_{50}$ values.

For certain further embodiments, the multivalent cell-targeting molecule of the present invention exhibits low cytotoxic potency (i.e. is not capable when introduced to certain positive target cell types of exhibiting a cytotoxicity greater than 1% cell death of a cell population at a multivalent cell-targeting molecule concentration of 1000 nM, 500 nM, 100 nM, 75 nM, or 50 nM) and is capable when introduced to cells of exhibiting a greater subcellular routing efficiency from an extracellular space to a subcellular compartment of an endoplasmic reticulum and/or cytosol as compared to the subcellular routing efficiency of the second, third, fourth, fifth, sixth, seventh, eighth, and/or ninth cell-targeting molecule.

Embodiment Set #12—Multivalent Cell-Targeting Molecules Comprising a Carboxy-Terminal Endoplasmic Reticulum Retention/Retrieval Signal Motif and a Shiga Toxin Effector Polypeptide Comprising an Embedded or Inserted, Heterologous, T-Cell Epitope The present invention provides multivalent cell-targeting molecules, each comprising (i) two or more binding regions, each capable of specifically binding an extracellular part of the same target biomolecule; (ii) a Shiga toxin effector polypeptide comprising an inserted or embedded, heterologous epitope; and (iii) a carboxy-terminal, endoplasmic reticulum retention/retrieval signal motif. In certain embodiments, the cell-targeting molecule of the present invention comprises (i) two or more binding regions, each capable of specifically binding an extracellular target biomolecule; (ii) a Shiga toxin effector polypeptide comprising an embedded or inserted, heterologous epitope; and (iii) a carboxy-terminal, endoplasmic reticulum retention/retrieval signal motif of a member of the KDEL family. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain embodiments, the heterologous epitope is a CD8+ T-cell epitope, such as, e.g., with regard to a human immune system. For certain further embodiments, the heterologous, CD8+ T-cell epitope is capable of being presented by a MHC class I molecule of a cell. For certain embodiments of Embodiment Set #12, the cell-targeting molecule of the present invention is capable of one or more the following: entering a cell, inhibiting a ribosome function, causing cytostasis, causing cell death, and/or delivering the embedded or inserted, heterologous T-cell epitope to a MHC class I molecule for presentation on a cellular surface.

In certain embodiments of Embodiment Set #12, the carboxy-terminal endoplasmic reticulum retention/retrieval signal motif is selected from the group consisting of: KDEL, HDEF, HDEL, RDEF, RDEL, WDEL, YDEL, HEEF, HEEL, KEEL, REEL, KAEL, KCEL, KFEL, KGEL, KHEL, KLEL, KNEL, KQEL, KREL, KSEL, KVEL, KWEL, KYEL, KEDL, KIEL, DKEL, FDEL, KDEF, KKEL, HADL, HAEL, HIEL, HNEL, HTEL, KTEL, HVEL, NDEL, QDEL, REDL, RNEL, RTDL, RTEL, SDEL, TDEL, SKEL, STEL, and EDEL.

In certain embodiments of Embodiment Set #12, the inserted or embedded, heterologous, T-cell epitope disrupts the endogenous, B-cell and/or T-cell epitope region selected from the group of natively positioned Shiga toxin A Subunit regions consisting of: (i) 1-15 of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; and 53-66 of any one of SEQ ID NOs: 1-18, or the equivalent region in a Shiga toxin A Subunit or derivative thereof; (ii) 94-115 of any one of SEQ ID NOs: 1-18; 141-153 of any one of SEQ ID NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18, or the equivalent region in a Shiga toxin A Subunit or derivative thereof; and (iii) 240-260 of any one of SEQ ID NOs: 3 and 7-18; 243-257 of any one of SEQ ID NOs: 1-2 and 4-6; 254-268 of any one of SEQ ID NOs: 1-2 and 4-6; 262-278 of any one of SEQ ID NOs: 3 and 7-18; 281-297 of any one of SEQ ID NOs: 3 and 7-18; and 285-293 of any one of SEQ ID NOs: 1-2 and 4-6, or the equivalent region in a Shiga toxin A Subunit or derivative thereof.

For certain further embodiments of Embodiment Set #12, the heterologous epitope is a CD8+ T-cell epitope capable of being presented by a MHC class I molecule of a cell. In certain further embodiments, the heterologous epitope in is embedded and replaces an equivalent number of amino acid residues in a wild-type Shiga toxin polypeptide region such that the Shiga toxin effector polypeptide has the same total number of amino acid residues as does the wild-type Shiga toxin polypeptide region from which it is derived. For certain further embodiments of any of the above, the Shiga toxin effector polypeptide is capable of exhibiting at least one Shiga toxin effector function selected from: directing intracellular routing to a cytosol of a cell in which the polypeptide is present, inhibiting a ribosome function, enzymatically inactivating a ribosome, and cytotoxicity.

In certain embodiments of Embodiment Set #12, the cell-targeting molecule of the present invention is capable when introduced to cells of exhibiting cytotoxicity that is greater than that of a fifth cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the fifth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the fifth cell-targeting molecule to a second population of target positive cells as assayed by $CD_{50}$ values.

For certain embodiments of Embodiment Set #12, the cell-targeting molecule of the present invention is capable of delivering an embedded or inserted, heterologous, CD8+ T-cell epitope to a MHC class I presentation pathway of a cell for cell-surface presentation of the epitope bound by a MHC class I molecule.

For certain embodiments of Embodiment Set #12, the cell-targeting molecule is de-immunized due to the embedded or inserted, heterologous epitope. In certain further embodiments, the cell-targeting molecule is capable of exhibiting less relative antigenicity and/or relative immunogenicity as compared to a reference molecule, such as, e.g., a sixth cell-targeting molecule consisting of the cell-targeting molecule except for it lacks one or more embedded or inserted epitopes present in one or more Shiga toxin effector polypeptide components of the cell targeting molecule.

For certain further embodiments of Embodiment Set #12, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the subcellular routing efficiency of a reference molecule, such as, e.g., the fifth cell-targeting molecule.

Embodiment Set #13—Multivalent Cell-Targeting Molecules Comprising a Shiga Toxin Effector Polypeptide Comprising (i) an Embedded or Inserted, Heterologous, T-Cell Epitope and (ii) a Disrupted, Furin-Cleavage Motif at the Carboxy-Terminus of an A1 Fragment Derived Region The present invention provides multivalent cell-targeting molecules, each comprising (i) two or more binding regions, each capable of specifically binding an extracellular part of the same target biomolecule; (ii) a Shiga toxin effector polypeptide comprising an inserted or embedded, heterologous epitope; and (iii) a disrupted furin-cleavage motif. In certain embodiments, the cell-targeting molecule of the present invention comprises (i) a binding region capable of specifically binding an extracellular target biomolecule; (ii) a Shiga toxin effector polypeptide comprising (a) an inserted or embedded, heterologous epitope; (b) a Shiga toxin A1 fragment derived region having a carboxy terminus; and (c) a disrupted furin-cleavage motif at the carboxy-terminus of the A1 fragment derived region. In certain embodiments, the cell-targeting molecule of the present invention comprises (i) a binding region capable of specifically binding an extracellular target biomolecule; (ii) a Shiga toxin effector polypeptide comprising (a) an inserted or embedded, heterologous epitope; (b) a Shiga toxin A1 fragment region having a carboxy terminus; and (c) a disrupted furin-cleavage motif at the carboxy-terminus of the A1 fragment region. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the heterologous epitope is a CD8+ T-cell epitope, such as, e.g., with regard to a human immune system. For certain further embodiments, the heterologous, T-cell epitope is capable of being presented by a MHC class I molecule of a cell. In certain further embodiments, the cell-targeting molecule of the present invention is capable of one or more the following: entering a cell, inhibiting a ribosome function, causing cytostasis, causing cell death, and/or delivering the embedded or inserted, heterologous, T-cell epitope to a MHC class I molecule for presentation on a cellular surface. For certain further embodiments, the cell-targeting molecule is capable when introduced to cells of exhibiting a cytotoxicity comparable or better than a reference molecule, such as, e.g., a second cell-targeting molecule consisting of the cell-targeting molecule except for at least one of its Shiga toxin effector polypeptide components comprise a wild-type Shiga toxin furin-cleavage site at the carboxy terminus of its A1 fragment region. For certain further embodiments, the cell-targeting molecule is capable when introduced to cells of exhibiting a cytotoxicity comparable or better than a second cell-targeting molecule consisting of the cell-targeting molecule except for all of its Shiga toxin effector polypeptide components comprise a wild-type Shiga toxin furin-cleavage site at the carboxy terminus of its A1 fragment region.

In certain embodiments of Embodiment Set #13, the inserted or embedded, heterologous, epitope disrupts the endogenous, B-cell and/or T-cell epitope region selected from the group of natively positioned Shiga toxin A Subunit regions consisting of: (i) 1-15 of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; and 53-66 of any one of SEQ ID NOs: 1-18, or the equivalent region in a Shiga toxin A Subunit or derivative thereof; (ii) 94-115 of any one of SEQ ID NOs: 1-18; 141-153 of any one of SEQ ID NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18, or the equivalent region in a Shiga toxin A Subunit or derivative thereof; and (iii) 240-260 of any one of SEQ ID NOs: 3 and 7-18; 243-257 of any one of SEQ ID NOs: 1-2 and 4-6; 254-268 of any one of SEQ ID NOs: 1-2 and 4-6; 262-278 of any one of SEQ ID NOs: 3 and 7-18; 281-297 of any one of SEQ ID NOs: 3 and 7-18; and 285-293 of any one of SEQ ID NOs: 1-2 and 4-6, or the equivalent region in a Shiga toxin A Subunit or derivative thereof.

In certain embodiments of Embodiment Set #13, the disrupted furin-cleavage motif comprises one or more mutations, relative to a wild-type Shiga toxin A Subunit, the mutation altering at least one amino acid residue in a region natively positioned at 248-251 of the A Subunit of Shiga toxin (SEQ ID NOs: 1-2 and 4-6), or at 247-250 of the A Subunit of Shiga-like toxin 2 (SEQ ID NOs: 3 and 7-18), or the equivalent region in a Shiga toxin A Subunit or derivative thereof. In certain further embodiments, the disrupted furin-cleavage motif comprises one or more mutations, relative to a wild-type Shiga toxin A Subunit, in a minimal furin cleavage site of the furin-cleavage motif. In certain further embodiments the minimal furin cleavage site is represented by the consensus amino acid sequence R/Y-x-x-R and/or R-x-x-R.

In certain embodiments of Embodiment Set #13, the cell-targeting molecule comprises a molecular moiety located carboxy-terminal to the carboxy-terminus of the Shiga toxin A1 fragment region or Shiga toxin A1 fragment derived region.

In certain embodiments of Embodiment Set #13, the binding region sterically covers the carboxy-terminus of the A1 fragment region or Shiga toxin A1 fragment derived region.

In certain embodiments of Embodiment Set #13, the molecular moiety sterically covers the carboxy-terminus of the A1 fragment region or Shiga toxin A1 fragment derived region. In certain further embodiments, the molecular moiety comprises the binding region.

In certain embodiments of Embodiment Set #13, the cell-targeting molecule of the present invention comprises a binding region and/or molecular moiety located carboxy-terminal to the carboxy-terminus of the Shiga toxin A1 fragment region or Shiga toxin A1 fragment derived region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Set #13, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #13, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

In certain embodiments of Embodiment Set #13, the disrupted furin-cleavage motif comprises an amino acid residue substitution in the furin-cleavage motif relative to a wild-type Shiga toxin A Subunit. In certain further embodiments, the substitution of the amino acid residue in the furin-cleavage motif is of an arginine residue with a non-positively charged, amino acid residue selected from the group consisting of: alanine, glycine, proline, serine, threonine, aspartate, asparagine, glutamate, glutamine, cysteine, isoleucine, leucine, methionine, valine, phenylalanine, tryptophan, and tyrosine. In certain embodiments, the substitution of the amino acid residue in the furin-cleavage motif is of an arginine residue with a histidine.

In certain embodiments of Embodiment Set #13, the cell-targeting molecule is capable when introduced to cells of exhibiting cytotoxicity comparable to the cytotoxicity of a seventh cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region and/or Shiga toxin A1 fragment derived region. In certain further embodiments, the cell-targeting molecule of the present invention is capable when introduced to cells of exhibiting cytotoxicity that is in a range of from 0.1-fold, 0.5-fold, or 0.75-fold to 1.2-fold, 1.5-fold, 1.75-fold, 2-fold, 3-fold, 4-fold, or 5-fold of the cytotoxicity exhibited by the seventh cell-targeting molecule.

In certain embodiments of Embodiment Set #13, the cell-targeting molecule is capable when introduced to a chordate of exhibiting improved, in vivo tolerability compared to in vivo tolerability of the seventh cell-targeting molecule. For embodiments, wherein the molecular moiety is not toxic and the molecular moiety comprises the binding region, the cell-targeting molecule is capable when introduced to a chordate of exhibiting improved, in vivo tolerability compared to in vivo tolerability of the seventh cell-targeting molecule only when all the binding regions of the cell-targeting molecule are associated or linked, either directly or indirectly, to a Shiga toxin effector polypeptide at a position carboxy-terminal to the carboxy-terminus of the Shiga toxin A1 fragment region and/or Shiga toxin A1 fragment derived region of that Shiga toxin effector polypeptide.

In certain embodiments of Embodiment Set #13, the cell-targeting molecule is de-immunized due to the embedded or inserted, heterologous epitope. In certain further embodiments, the cell-targeting molecule is capable of exhibiting less relative antigenicity and/or relative immunogenicity as compared to a reference molecule, such as, e.g., an eighth cell-targeting molecule consisting of the cell-targeting molecule except for it lacks one or more embedded or inserted epitopes present in the cell targeting molecule.

In certain embodiments of Embodiment Set #13, the cell-targeting molecule is de-immunized due to the furin-cleavage motif disruption. In certain further embodiments, the cell-targeting molecule is capable of exhibiting less relative antigenicity and/or relative immunogenicity as compared to a ninth cell-targeting molecule consisting of the cell-targeting molecule except for the furin-cleavage motif is wild-type and/or all the Shiga toxin effector polypeptide components consist of a wild-type Shiga toxin A1 fragment.

Embodiment Set #14—Multivalent Cell-Targeting Molecules Comprising a Shiga Toxin Effector Polypeptide at or Proximal to an Amino-Terminus and Wherein the Shiga Toxin Effector Polypeptide Comprises an Embedded or Inserted, Heterologous, T-Cell Epitope The present invention provides multivalent cell-targeting molecules, each comprising (i) two or more binding regions, each capable of specifically binding an extracellular part of the same target biomolecule; (ii) a Shiga toxin effector polypeptide comprising an inserted or embedded, heterologous epitope; wherein the Shiga toxin effector polypeptide is at or proximal to an amino-terminus of a polypeptide. In certain embodiments, the cell-targeting molecule of the present invention comprises (i) a binding region capable of specifically binding an extracellular target biomolecule, (ii) a polypeptide component, and (iii) a Shiga toxin effector polypeptide comprising an inserted or embedded, heterologous epitope; wherein the Shiga toxin effector polypeptide is at or proximal to an amino-terminus of the polypeptide component of the cell-targeting molecule. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. In certain further embodiments, the binding region is not located proximally to an amino-terminus of the cell-targeting molecule relative to the Shiga toxin effector polypeptide. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the heterologous, T-cell epitope is a CD8+ T-cell epitope, such as, e.g., with regard to a human immune system. For certain further embodiments, the heterologous, T-cell epitope is capable of being presented by a MHC class I molecule of a cell. In certain further embodiments, the cell-targeting molecule of the present invention is capable of one or more the following: entering a cell, inhibiting a ribosome function, causing cytostasis, causing cell death, and/or delivering the embedded or inserted, heterologous, T-cell epitope to a MHC class I molecule for presentation on a cellular surface.

In certain embodiments of Embodiment Set #14, the cell-targeting molecule of the present invention is capable when introduced to cells of exhibiting cytotoxicity that is greater than that of a tenth cell-targeting molecule having an amino-terminus and comprising the binding region and the Shiga toxin effector polypeptide region which is not positioned at or proximal to the amino-terminus of the tenth cell-targeting molecule. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the tenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the tenth cell-targeting molecule to a second population of target positive cells as assayed by $CD_{50}$ values.

For certain embodiments of Embodiment Set #14, the cell-targeting molecule of the present invention is capable of delivering an embedded or inserted, heterologous, CD8+ T-cell epitope to a MHC class I presentation pathway of a cell for cell-surface presentation of the epitope bound by a MHC class I molecule.

In certain embodiments of Embodiment Set #14, the cell-targeting molecule is de-immunized due to the embedded or inserted, heterologous epitope. In certain further embodiments, the cell-targeting molecule is capable of exhibiting less relative antigenicity and/or relative immunogenicity as compared to a reference molecule, such as, e.g., an eleventh cell-targeting molecule consisting of the cell-targeting molecule except for it lacks one or more embedded or inserted epitopes present in the cell targeting molecule.

For certain further embodiments of Embodiment Set #14, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the tenth cell-targeting molecule.

Embodiment Set #15—Multivalent Cell-Targeting Molecule Comprising a De-Immunized Shiga Toxin Effector Polypeptide Comprising a Disrupted, Furin-Cleavage Motif The present invention provides multivalent cell-targeting molecules, each comprising (i) two or more binding regions, each capable of specifically binding an extracellular part of the same target biomolecule, and (ii) a de-immunized, Shiga toxin effector polypeptide comprising a disrupted furin-cleavage motif. In certain embodiments, the cell-targeting molecule of the present invention comprises (i) a binding region capable of specifically binding an extracellular target biomolecule and (ii) a de-immunized, Shiga toxin effector polypeptide comprising (a) a Shiga toxin A1 fragment derived region having a carboxy terminus, (b) a disrupted furin-cleavage motif at the carboxy-terminus of the A1 fragment region, and (c) at least one disrupted, endogenous, B-cell and/or CD4+ T-cell epitope and/or epitope region. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death. For certain further embodiments, the cell-targeting molecule is capable when introduced to cells of exhibiting a cytotoxicity comparable or better than a reference molecule, such as, e.g., a second cell-targeting molecule consisting of the cell-targeting molecule except for all of its Shiga toxin effector polypeptide components comprise a wild-type Shiga toxin furin-cleavage site at the carboxy terminus of its A1 fragment region.

In certain embodiments of Embodiment Set #15, the Shiga toxin effector polypeptide comprises a mutation, relative to a wild-type Shiga toxin A Subunit, in the B-cell and/or T-cell epitope region selected from the group of natively positioned Shiga toxin A Subunit regions consisting of; 1-15 of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; and 53-66 of any one of SEQ ID NOs: 1-18; 94-115 of any one of SEQ ID NOs: 1-18; 141-153 of any one of SEQ ID NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18; 240-260 of any one of SEQ ID NOs: 3 and 7-18; 243-257 of any one of SEQ ID NOs: 1-2 and 4-6; 254-268 of any one of SEQ ID NOs: 1-2 and 4-6; 262-278 of any one of SEQ ID NOs: 3 and 7-18; 281-297 of any one of SEQ ID NOs: 3 and 7-18; and 285-293 of any one of SEQ ID NOs: 1-2 and 4-6; or the equivalent region in a Shiga toxin A Subunit or derivative thereof. In certain further embodiments, there is no disruption which is a carboxy-terminal truncation of amino acid residues that overlap with part or all of at least one disrupted, endogenous, B-cell and/or T-cell epitope and/or epitope region.

In certain embodiments of Embodiment Set #15, the disrupted furin-cleavage motif comprises one or more mutations, relative to a wild-type Shiga toxin A Subunit, the mutation altering at least one amino acid residue in a region natively positioned at 248-251 of the A Subunit of Shiga toxin (SEQ ID NOs: 1-2 and 4-6), or at 247-250 of the A Subunit of Shiga-like toxin 2 (SEQ ID NOs: 3 and 7-18), or the equivalent region in a Shiga toxin A Subunit or derivative thereof. In certain further embodiments, the disrupted furin-cleavage motif comprises one or more mutations, relative to a wild-type Shiga toxin A Subunit, in a minimal furin cleavage site of the furin-cleavage motif. In certain further embodiments the minimal furin cleavage site is represented by the consensus amino acid sequence R/Y-x-x-R and/or R-x-x-R.

In certain embodiments of Embodiment Set #15, the cell-targeting molecule comprises a molecular moiety located carboxy-terminal to the carboxy-terminus of the Shiga toxin A1 fragment region.

In certain embodiments of Embodiment Set #15, the binding region sterically covers the carboxy-terminus of the A1 fragment region.

In certain embodiments of Embodiment Set #15, the molecular moiety sterically covers the carboxy-terminus of the A1 fragment region. In certain further embodiments, the molecular moiety comprises the binding region.

In certain embodiments of Embodiment Set #15, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Set #15, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #15, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

In certain embodiments of Embodiment Set #15, the disrupted furin-cleavage motif comprises an amino acid residue substitution in the furin-cleavage motif relative to a wild-type Shiga toxin A Subunit. In certain further embodiments, the substitution of the amino acid residue in the furin-cleavage motif is of an arginine residue with a non-positively charged, amino acid residue selected from the group consisting of: alanine, glycine, proline, serine, threonine, aspartate, asparagine, glutamate, glutamine, cysteine, isoleucine, leucine, methionine, valine, phenylalanine, tryptophan, and tyrosine. In certain embodiments, the substitution of the amino acid residue in the furin-cleavage motif is of an arginine residue with a histidine.

In certain embodiments of Embodiment Set #15, the cell-targeting molecule is capable when introduced to cells of exhibiting cytotoxicity comparable to the cytotoxicity of a reference molecule, such as, e.g., a twelfth cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region. In certain further embodiments, the cell-targeting molecule of the present invention is capable when introduced to cells of exhibiting cytotoxicity that is in a range of from 0.1-fold, 0.5-fold, or 0.75-fold to 1.2-fold, 1.5-fold, 1.75-fold, 2-fold, 3-fold, 4-fold, or 5-fold of the cytotoxicity exhibited by the twelfth cell-targeting molecule.

In certain embodiments of Embodiment Set #15, the cell-targeting molecule is capable when introduced to a chordate of exhibiting improved, in vivo tolerability compared to in vivo tolerability of the twelfth cell-targeting molecule.

In certain embodiments of Embodiment Set #15, the cell-targeting molecule is de-immunized due to the furin-cleavage motif disruption. In certain further embodiments, the cell-targeting molecule is capable of exhibiting less relative antigenicity and/or relative immunogenicity as compared to a reference cell-targeting molecule consisting of the cell-targeting molecule except for the furin-cleavage motif is wild-type and/or all the Shiga toxin effector polypeptide components consist of a wild-type Shiga toxin A1 fragment, such as, e.g., the twelfth cell-targeting molecule.

In certain embodiments of Embodiment Set #15, the cell-targeting molecule of the present invention comprises two proteins selected from any one of the polypeptides shown in any one of SEQ ID NOs: 252-255, 259-271, 274-278 and 288-748, and which optionally comprises an amino-terminal methionine residue.

Embodiment Set #16—Multivalent Cell-Targeting Molecule Comprising a Carboxy-Terminal Endoplasmic Reticulum Retention/Retrieval Signal Motif and a De-Immunized Shiga Toxin Effector Polypeptide The present invention provides multivalent cell-targeting molecules, each comprising (i) two or more binding regions, each capable of specifically binding an extracellular part of the same target biomolecule; (ii) a de-immunized, Shiga toxin effector polypeptide, and (iii) a carboxy-terminal, endoplasmic reticulum retention/retrieval signal motif. In certain embodiments, the cell-targeting molecule of the present invention comprises (i) a binding region capable of specifically binding an extracellular target biomolecule; (ii) a de-immunized, Shiga toxin effector polypeptide comprising at least one disrupted, endogenous, B-cell and/or CD4+ T-cell epitope and/or epitope region, and (iii) a carboxy-terminal, endoplasmic reticulum retention/retrieval signal motif of a member of the KDEL family. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death.

In certain embodiments of Embodiment Set #16, the carboxy-terminal endoplasmic reticulum retention/retrieval signal motif is selected from the group consisting of: KDEL, HDEF, HDEL, RDEF, RDEL, WDEL, YDEL, HEEF, HEEL, KEEL, REEL, KAEL, KCEL, KFEL, KGEL, KHEL, KLEL, KNEL, KQEL, KREL, KSEL, KVEL, KWEL, KYEL, KEDL, KIEL, DKEL, FDEL, KDEF, KKEL, HADL, HAEL, HIEL, HNEL, HTEL, KTEL, HVEL, NDEL, QDEL, REDL, RNEL, RTDL, RTEL, SDEL, TDEL, SKEL, STEL, and EDEL.

In certain embodiments of Embodiment Set #16, the Shiga toxin effector polypeptide comprises a mutation, relative to a wild-type Shiga toxin A Subunit, in the B-cell and/or T-cell epitope region selected from the group of natively positioned Shiga toxin A Subunit regions consisting of: 1-15 of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; and 53-66 of any one of SEQ ID NOs: 1-18; 94-115 of any one of SEQ ID NOs: 1-18; 141-153 of any one of SEQ ID NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18; 240-260 of any one of SEQ ID NOs: 3 and 7-18; 243-257 of any one of SEQ ID NOs: 1-2 and 4-6; 254-268 of any one of SEQ ID NOs: 1-2 and 4-6; 262-278 of any one of SEQ ID NOs: 3 and 7-18; 281-297 of any one of SEQ ID NOs: 3 and 7-18; and 285-293 of any one of SEQ ID NOs: 1-2 and 4-6; or the equivalent region in a Shiga toxin A Subunit or derivative thereof. In certain further embodiments, there is no disruption which is a carboxy-terminal truncation of amino acid residues that overlap with part or all of at least one disrupted, endogenous, B-cell and/or T-cell epitope and/or epitope region.

In certain embodiments of Embodiment Set #16, the cell-targeting molecule of the present invention is capable when introduced to cells of exhibiting cytotoxicity that is greater than that of a thirteenth cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the thirteenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the thirteenth cell-targeting molecule to a second population of target positive cells as assayed by $CD_{50}$ values.

For certain further embodiments of Embodiment Set #16, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the thirteenth cell-targeting molecule.

Embodiment Set #17—Multivalent Cell-Targeting Molecule Comprising a De-Immunized Shiga Toxin Effector Polypeptide at or Proximal to an Amino-Terminus of the Cell Targeting Molecule The present invention provides multivalent cell-targeting molecules, each comprising (i) two or more binding regions, each capable of specifically binding an extracellular part of the same target biomolecule, (ii) a de-immunized, Shiga toxin effector polypeptide; wherein the Shiga toxin effector polypeptide is at or proximal to an amino-terminus. In certain embodiments, the cell-targeting molecule of the present invention comprises (i) a binding region capable of specifically binding an extracellular target biomolecule; (ii) polypeptide component; and (iii) a de-immunized, Shiga toxin effector polypeptide comprising at least one disrupted, endogenous, B-cell and/or CD4+ T-cell epitope and/or epitope region; wherein the Shiga toxin effector polypeptide is at or proximal to an amino-terminus of the polypeptide component of the cell-targeting molecule. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. In certain further embodiments, the binding region is not located proximally to an amino-terminus of the cell-targeting molecule relative to the Shiga toxin effector polypeptide. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death.

In certain embodiments of Embodiment Set #17, the Shiga toxin effector polypeptide comprises a mutation, relative to a wild-type Shiga toxin A Subunit, in the B-cell and/or T-cell epitope region selected from the group of natively positioned Shiga toxin A Subunit regions consisting of: 1-15 of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; and 53-66 of any one of SEQ ID NOs: 1-18; 94-115 of any one of SEQ ID NOs: 1-18; 141-153 of any one of SEQ ID NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18; 240-260 of any one of SEQ ID NOs: 3 and 7-18; 243-257 of any one of SEQ ID NOs: 1-2 and 4-6; 254-268 of any one of SEQ ID NOs: 1-2 and 4-6; 262-278 of any one of SEQ ID NOs: 3 and 7-18; 281-297 of any one of SEQ ID NOs: 3 and 7-18; and 285-293 of any one of SEQ ID NOs: 1-2 and 4-6; or the equivalent region in a Shiga toxin A Subunit or derivative thereof. In certain further embodiments, there is no disruption which is a carboxy-terminal truncation of amino acid residues that overlap with part or all of at least one disrupted, endogenous, B-cell and/or T-cell epitope and/or epitope region.

In certain embodiments of Embodiment Set #17, the cell-targeting molecule of the present invention is capable when introduced to cells of exhibiting cytotoxicity that is greater than that of a fourteenth cell-targeting molecule having an amino-terminus and comprising the binding region and the Shiga toxin effector polypeptide region which is not positioned at or proximal to the amino-terminus of the fourteenth cell-targeting molecule. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the fourteenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the fourteenth cell-targeting molecule to a second population of target positive cells as assayed by $CD_{50}$ values.

For certain further embodiments of Embodiment Set #17, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the fourteenth cell-targeting molecule.

In certain embodiments of Embodiment Set #17, the cell-targeting molecule of the present invention comprises two proteins selected from any one of the polypeptides shown in any one of SEQ ID NOs: 252-255, 259-271, 274-278 and 288-748, and which optionally comprises an amino-terminal methionine residue.

Embodiment Set #18—Multivalent Cell-Targeting Molecule Comprising a Carboxy-Terminal Endoplasmic Reticulum Retention/Retrieval Signal Motif and a Shiga Toxin Effector Polypeptide Comprising a Disrupted, Furin-Cleavage Motif The present invention provides multivalent cell-targeting molecules, each comprising (i) two or more binding regions, each capable of specifically binding an extracellular part of the same target biomolecule; (ii) a Shiga toxin effector polypeptide comprising a disrupted furin-cleavage motif; and (iii) a carboxy-terminal endoplasmic reticulum retention/retrieval signal motif. The present invention provides cell-targeting molecules, each comprising (i) a binding region capable of specifically binding an extracellular target biomolecule; (ii) a Shiga toxin effector polypeptide comprising a disrupted furin-cleavage motif; and (iii) a carboxy-terminal, endoplasmic reticulum retention/retrieval signal motif of a member of the KDEL family. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death. For certain further embodiments, the cell-targeting molecule is capable when introduced to cells of exhibiting a cytotoxicity comparable or better than a reference molecule, such as, e.g., a second cell-targeting molecule consisting of the cell-targeting molecule except for all of its Shiga toxin effector polypeptide components comprise a wild-type Shiga toxin furin-cleavage site at the carboxy terminus of its A1 fragment region.

In certain embodiments of Embodiment Set #18, the disrupted furin-cleavage motif comprises one or more mutations, relative to a wild-type Shiga toxin A Subunit, the mutation altering at least one amino acid residue in a region natively positioned at 248-251 of the A Subunit of Shiga toxin (SEQ ID NOs: 1-2 and 4-6), or at 247-250 of the A Subunit of Shiga-like toxin 2 (SEQ ID NOs: 3 and 7-18), or the equivalent region in a Shiga toxin A Subunit or derivative thereof. In certain further embodiments, the disrupted furin-cleavage motif comprises one or more mutations, relative to a wild-type Shiga toxin A Subunit, in a minimal furin cleavage site of the furin-cleavage motif. In certain further embodiments the minimal furin cleavage site is represented by the consensus amino acid sequence R/Y-x-x-R and/or R-x-x-R.

In certain embodiments of Embodiment Set #18, the cell-targeting molecule comprises a molecular moiety located carboxy-terminal to the carboxy-terminus of the Shiga toxin A1 fragment region.

In certain embodiments of Embodiment Set #18, the binding region sterically covers the carboxy-terminus of the A1 fragment region.

In certain embodiments of Embodiment Set #18, the molecular moiety sterically covers the carboxy-terminus of the A1 fragment region. In certain further embodiments, the molecular moiety comprises the binding region.

In certain embodiments of Embodiment Set #18, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Set #18, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #18, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

In certain embodiments of Embodiment Set #18, the disrupted furin-cleavage motif comprises an amino acid residue substitution in the furin-cleavage motif relative to a wild-type Shiga toxin A Subunit. In certain further embodiments, the substitution of the amino acid residue in the furin-cleavage motif is of an arginine residue with a non-positively charged, amino acid residue selected from the group consisting of: alanine, glycine, proline, serine, threonine, aspartate, asparagine, glutamate, glutamine, cysteine, isoleucine, leucine, methionine, valine, phenylalanine, tryptophan, and tyrosine. In certain embodiments, the substitution of the amino acid residue in the furin-cleavage motif is of an arginine residue with a histidine.

In certain embodiments of Embodiment Set #18, the cell-targeting molecule of the present invention is capable when introduced to cells of exhibiting cytotoxicity that is greater than that of a fifteenth cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the fifteenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the fifteenth cell-targeting molecule to a second population of target positive cells as assayed by $CD_{50}$ values.

In certain embodiments of Embodiment Set #18, the cell-targeting molecule is capable when introduced to a chordate of exhibiting improved, in vivo tolerability compared to in vivo tolerability of a sixteenth cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region.

In certain embodiments of Embodiment Set #18, the cell-targeting molecule is de-immunized due to the furin-cleavage motif disruption. In certain further embodiments, the cell-targeting molecule is capable of exhibiting less relative antigenicity and/or relative immunogenicity as compared to a reference cell-targeting molecule consisting of the cell-targeting molecule except for the furin-cleavage motif is wild-type and/or all the Shiga toxin effector polypeptide components consist of a wild-type Shiga toxin A1 fragment, such as, e.g., the sixteenth cell-targeting molecule.

For certain further embodiments of Embodiment Set #18, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the fifteenth cell-targeting molecule.

Embodiment Set #19—Multivalent Cell-Targeting Molecule Comprising a Furin-Cleavage Resistant Shiga Toxin Effector Polypeptide at or Proximal to an Amino-Terminus of the Cell Targeting Molecule The present invention provides multivalent cell-targeting molecules, each comprising (i) two or more binding regions, each capable of specifically binding an extracellular part of the same target biomolecule, and (ii) a Shiga toxin effector polypeptide comprising a disrupted furin-cleavage motif at the carboxy-terminus of its Shiga toxin A1 fragment region; wherein the amino-terminus of the Shiga toxin effector polypeptide is at and/or proximal to an amino-terminus of a polypeptide component of the cell-targeting molecule. In certain embodiments, the cell-targeting molecule of the present invention comprises (i) a binding region capable of specifically binding an extracellular target biomolecule, (ii) a Shiga toxin effector polypeptide having an amino-terminus and a Shiga toxin A1 fragment derived region having a carboxy terminus, and (iii) a disrupted furin-cleavage motif at the carboxy-terminus of the A1 fragment region; wherein the binding region is not located proximally to the amino-terminus of the cell-targeting molecule relative to the Shiga toxin effector polypeptide. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. In certain further embodiments, the binding region is not located proximally to an amino-terminus of the cell-targeting molecule relative to the Shiga toxin effector polypeptide. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death. For certain further embodiments, the cell-targeting molecule is capable when introduced to cells of exhibiting a cytotoxicity comparable or better than a reference molecule, such as, e.g., a seventeenth cell-targeting molecule consisting of the cell-targeting molecule except for all of its Shiga toxin effector polypeptide components comprise a wild-type Shiga toxin furin-cleavage site at the carboxy terminus of its A1 fragment region.

In certain embodiments of Embodiment Set #19, the disrupted furin-cleavage motif comprises one or more mutations, relative to a wild-type Shiga toxin A Subunit, the mutation altering at least one amino acid residue in a region natively positioned at 248-251 of the A Subunit of Shiga toxin (SEQ ID NOs: 1-2 and 4-6), or at 247-250 of the A Subunit of Shiga-like toxin 2 (SEQ ID NOs: 3 and 7-18), or the equivalent region in a Shiga toxin A Subunit or derivative thereof. In certain further embodiments, the disrupted furin-cleavage motif comprises one or more mutations, relative to a wild-type Shiga toxin A Subunit, in a minimal furin cleavage site of the furin-cleavage motif. In certain further embodiments the minimal furin cleavage site is represented by the consensus amino acid sequence R/Y-x-x-R and/or R-x-x-R.

In certain embodiments of Embodiment Set #19, the cell-targeting molecule comprises a molecular moiety located carboxy-terminal to the carboxy-terminus of the Shiga toxin A1 fragment region.

In certain embodiments of Embodiment Set #19, the binding region sterically covers the carboxy-terminus of the A1 fragment region.

In certain embodiments of Embodiment Set #19, the molecular moiety sterically covers the carboxy-terminus of the A1 fragment region. In certain further embodiments, the molecular moiety comprises the binding region.

In certain embodiments of Embodiment Set #19, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Set #19, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #19, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

In certain embodiments of Embodiment Set #19, the disrupted furin-cleavage motif comprises an amino acid residue substitution in the furin-cleavage motif relative to a wild-type Shiga toxin A Subunit. In certain further embodiments, the substitution of the amino acid residue in the furin-cleavage motif is of an arginine residue with a non-positively charged, amino acid residue selected from the group consisting of: alanine, glycine, proline, serine, threonine, aspartate, asparagine, glutamate, glutamine, cysteine, isoleucine, leucine, methionine, valine, phenylalanine, tryptophan, and tyrosine. In certain embodiments, the substitution of the amino acid residue in the furin-cleavage motif is of an arginine residue with a histidine.

In certain embodiments of Embodiment Set #19, the cell-targeting molecule of the present invention is capable when introduced to cells of exhibiting cytotoxicity that is greater than that of an eighteenth cell-targeting molecule having an amino-terminus and comprising the binding region and the Shiga toxin effector polypeptide region which is not positioned at or proximal to the amino-terminus of the eighteenth cell-targeting molecule. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the eighteenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the eighteenth cell-targeting molecule to a second population of target positive cells as assayed by $CD_{50}$ values.

In certain embodiments of Embodiment Set #19, the cell-targeting molecule is capable when introduced to a chordate of exhibiting improved, in vivo tolerability compared to in vivo tolerability of a nineteenth cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region.

In certain embodiments of Embodiment Set #19, the cell-targeting molecule is de-immunized due to the furin-cleavage motif disruption. In certain further embodiments, the cell-targeting molecule is capable of exhibiting less relative antigenicity and/or relative immunogenicity as compared to a reference cell-targeting molecule consisting of the cell-targeting molecule except for the furin-cleavage motif is wild-type and/or all the Shiga toxin effector polypeptide components consist of a wild-type Shiga toxin A1 fragment, such as, e.g., the nineteenth cell-targeting molecule.

For certain further embodiments of Embodiment Set #19, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the nineteenth cell-targeting molecule.

In certain embodiments of Embodiment Set #19, the cell-targeting molecule of the present invention comprises two proteins selected from any one of the polypeptides shown in any one of SEQ ID NOs: 252-255, 259-271, 274-278 and 288-748, and which optionally comprises an amino-terminal methionine residue.

Embodiment Set #20—Multivalent Cell-Targeting Molecule Comprising a Carboxy-Terminal Endoplasmic Reticulum Retention/Retrieval Signal Motif and Shiga Toxin Effector Polypeptide at or Proximal to an Amino-Terminus of the Cell Targeting Molecule The present invention provides multivalent cell-targeting molecules, each comprising (i) two or more binding regions, each capable of specifically binding an extracellular part of the same target biomolecule, (ii) a carboxy-terminal, endoplasmic reticulum retention/retrieval signal motif, and (iii) a Shiga toxin effector polypeptide; wherein the amino-terminus of the Shiga toxin effector polypeptide is at and/or proximal to an amino-terminus of a polypeptide component of the cell-targeting molecule. In certain embodiments, the cell-targeting molecule of the present invention comprises a (i) binding region capable of specifically binding an extracellular target biomolecule, (ii) a carboxy-terminal, endoplasmic reticulum retention/retrieval signal motif of a member of the KDEL family, (iii) a polypeptide component, and (iv) a Shiga toxin effector polypeptide; wherein the amino-terminus of the Shiga toxin effector polypeptide is at and/or proximal to an amino-terminus of a polypeptide component of the cell-targeting molecule. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. In certain further embodiments, the binding region is not located proximally to an amino-terminus of the cell-targeting molecule relative to the Shiga toxin effector polypeptide.

For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death.

In certain embodiments of Embodiment Set #20, the carboxy-terminal endoplasmic reticulum retention/retrieval signal motif is selected from the group consisting of: KDEL, HDEF, HDEL, RDEF, RDEL, WDEL, YDEL, HEEF, HEEL, KEEL, REEL, KAEL, KCEL, KFEL, KGEL, KHEL, KLEL, KNEL, KQEL, KREL, KSEL, KVEL, KWEL, KYEL, KEDL, KIEL, DKEL, FDEL, KDEF, KKEL, HADL, HAEL, HIEL, HNEL, HTEL, KTEL, HVEL, NDEL, QDEL, REDL, RNEL, RTDL, RTEL, SDEL, TDEL, SKEL, STEL, and EDEL.

In certain embodiments of Embodiment Set #20, the cell-targeting molecule of the present invention is capable when introduced to cells of exhibiting cytotoxicity that is greater than that of a twentieth cell-targeting molecule having an amino-terminus and comprising the binding region and the Shiga toxin effector polypeptide region which is not positioned at or proximal to the amino-terminus of the twentieth cell-targeting molecule and/or greater than that of a twenty-first cell-targeting molecule consisting of the cell-targeting molecule except for it does not comprise any carboxy-terminal, endoplasmic reticulum retention/retrieval signal motif of the KDEL family. In certain further embodiments, the twentieth cell-targeting molecule does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to a reference molecule, such as, e.g., the twentieth and/or twenty-first cell-targeting molecules. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the twentieth and/or twenty-first cell-targeting molecules to a second population of target positive cells as assayed by $CD_{50}$ values.

For certain further embodiments of Embodiment Set #20, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the twentieth and/or twenty-first cell-targeting molecules.

Further Embodiments of Embodiment Sets #1-#20

In certain embodiments of Embodiment Sets #1 to #20, the heterologous, CD8+ T-cell epitope-peptide cargo is fused, either directly or indirectly, to the Shiga toxin effector polypeptide and/or the binding region. In certain further embodiments, the cell-targeting molecule comprises a single-chain polypeptide comprising the binding region, the Shiga toxin effector polypeptide, and the heterologous, CD8+ T-cell epitope-peptide cargo.

In certain embodiments of Embodiment Sets #1 to #20, the binding region comprises two or more polypeptide chains and the heterologous, CD8+ T-cell epitope-peptide cargo is fused either directly or indirectly, to a polypeptide comprising the Shiga toxin effector polypeptide and one of the two or more polypeptide chains of the binding region.

In certain embodiments of Embodiment Sets #1 to #20, the cell-targeting molecule of the present invention comprises a heterologous, CD8+ T-cell epitope-peptide cargo which is positioned within the cell-targeting molecule carboxy-terminal to the Shiga toxin effector polypeptide and/or binding region. In certain further embodiments, the cell-targeting molecule comprises two, three, four, five, or more heterologous, CD8+ T-cell epitope-peptide cargos positioned within the cell-targeting molecule carboxy-terminal to the Shiga toxin effector polypeptide and/or binding region.

In certain embodiments of Embodiment Sets #1 to #20, the cell-targeting molecule comprises a carboxy-terminal, heterologous, CD8+ T-cell epitope-peptide cargo.

For certain embodiments of Embodiment Sets #1 to #20, upon administration of the cell-targeting molecule to a target cell physically coupled with an extracellular target biomolecule of the binding region, the cell-targeting molecule is capable of causing intercellular engagement of the target cell by a CD8+ immune cell.

For certain embodiments of Embodiment Sets #1 to #20, upon administration of the cell-targeting molecule of the present invention to a target cell physically coupled with an extracellular target biomolecule of the binding region, the cell-targeting molecule is capable of causing intercellular engagement of the target cell by a CD8+ immune cell. For certain further embodiments, upon administration of the cell-targeting molecule of the present invention to a target cell physically coupled with an extracellular target biomolecule of the binding region, the cell-targeting molecule is capable of causing death of the target cell. For certain further embodiments, upon administration of the cell-targeting molecule of the present invention to a first population of cells whose members are physically coupled to extracellular target biomolecules of the binding region, and a second population of cells whose members are not physically coupled to any extracellular target biomolecule of the binding region, the cytotoxic effect of the cell-targeting molecule to members of said first population of cells relative to members of said second population of cells is at least 3-fold greater. In certain further embodiments, the cell-targeting molecule comprises or consists essentially of the polypeptide of any one of SEQ ID NOs: 252-255, 259-278, and 288-748. In certain embodiments, the Shiga toxin effector polypeptide comprises a mutation relative to a naturally occurring A Subunit of a member of the Shiga toxin family which changes the enzymatic activity of the Shiga toxin effector polypeptide, the mutation selected from at least one amino acid residue deletion, insertion, or substitution. In certain further embodiments, the mutation is selected from at least one amino acid residue deletion, insertion, or substitution that reduces or eliminates cytotoxicity of the toxin effector polypeptide. In certain embodiments, the binding region comprises the heterologous, CD8+ T-cell epitope cargo, whether the CD8+ epitope-peptide is autogenous or heterologous with respect to the binding region.

In certain embodiments of Embodiment Sets #1 to #20, the Shiga toxin effector polypeptide is fused to a binding region, either directly or indirectly, such as, e.g., via a linker known to the skilled worker.

In certain embodiments of Embodiment Sets #1 to #20, the cell-targeting molecule comprises a molecular moiety located carboxy-terminal to the carboxy-terminus of the Shiga toxin A1 fragment region.

In certain embodiments of Embodiment Sets #1 to #20, the Shiga toxin effector polypeptide has a Shiga toxin A1 fragment derived region having a carboxy terminus and further comprises a disrupted furin-cleavage motif at the carboxy-terminus of the A1 fragment region.

For certain embodiments of Embodiment Sets #1 to #20, the cell-targeting molecule of the present invention is capable of exhibiting (i) a catalytic activity level comparable to a wild-type Shiga toxin A1 fragment or wild-type Shiga toxin effector polypeptide, (ii) a ribosome inhibition activity with a half-maximal inhibitory concentration ($IC_{50}$) value of 10,000 picomolar or less, and/or (iii) a significant level of Shiga toxin catalytic activity.

For certain embodiments of Embodiment Sets #1 to #20, the cell-targeting molecule of the present invention is capable when introduced to cells of exhibiting a cytotoxicity with a half-maximal inhibitory concentration ($CD_{50}$) value of 300 nM or less and/or capable of exhibiting a significant level of Shiga toxin cytotoxicity.

For certain embodiments of Embodiment Sets #1 to #20, the cell-targeting molecule of the present invention exhibits low cytotoxic potency (i.e. is not capable when introduced to certain positive target cell types of exhibiting a cytotoxicity greater than 1% cell death of a cell population at a cell-targeting molecule concentration of 1000 nM, 500 nM, 100 nM, 75 nM, or 50 nM).

In certain embodiments of Embodiment Sets #1 to #20, the cell-targeting molecule of the present invention, or a polypeptide component thereof, comprises a carboxy-terminal, endoplasmic reticulum retention/retrieval signal motif of a member of the KDEL family. For certain further embodiments, the carboxy-terminal endoplasmic reticulum retention/retrieval signal motif is selected from the group consisting of: KDEL, HDEF, HDEL, RDEF, RDEL, WDEL, YDEL, HEEF, HEEL, KEEL, REEL, KAEL, KCEL, KFEL, KGEL, KHEL, KLEL, KNEL, KQEL, KREL, KSEL, KVEL, KWEL, KYEL, KEDL, KIEL, DKEL, FDEL, KDEF, KKEL, HADL, HAEL, HIEL, HNEL, HTEL, KTEL, HVEL, NDEL, QDEL, REDL, RNEL, RTDL, RTEL, SDEL, TDEL, SKEL, STEL, and EDEL. In certain further embodiments, the cell-targeting molecule of the present invention is capable when introduced to cells of exhibiting cytotoxicity that is greater than that of a reference molecule, such as, e.g., a twenty-second cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to a reference molecule, such as, e.g., the twenty-second cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the twenty-second cell-targeting molecule to a second population of target positive cells as assayed by $CD_{50}$ values.

In certain embodiments of Embodiment Sets #1 to #20, the Shiga toxin effector polypeptide further comprises at least one inserted or embedded, heterologous epitope.

In certain embodiments of Embodiment Sets #1 to #20, the Shiga toxin effector polypeptide further comprises at least one, two, or three disrupted, endogenous, B-cell and/or CD4+ T-cell epitope regions. In certain further embodiments, the Shiga toxin effector polypeptide comprises a disruption of at least one, two, or three endogenous, B-cell and/or T-cell epitopes and/or epitope regions. In certain further embodiments, the Shiga toxin effector polypeptide further comprises at least one disrupted, endogenous, B-cell and/or CD4+ T-cell epitope region which does not overlap with at least one inserted or embedded, heterologous epitope.

In certain embodiments of Embodiment #1 to #20, the amino-terminus of the Shiga toxin effector polypeptide is at and/or proximal to an amino-terminus of a polypeptide component of the cell-targeting molecule. In certain further embodiments, the binding region is not located proximally to the amino-terminus of the cell-targeting molecule relative to the Shiga toxin effector polypeptide. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. For certain further embodiments, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., a twenty-third cell-targeting molecule having an amino-terminus and comprising the binding region and the Shiga toxin effector polypeptide which is not positioned at or proximal to the amino-terminus of the third cell-targeting molecule. For certain further embodiments, the cell-targeting molecule of the present invention exhibits cytotoxicity with better optimized, cytotoxic potency, such as, e.g., 4-fold, 5-fold, 6-fold, 9-fold, or greater cytotoxicity as compared to the cytotoxicity of the twenty-third cell-targeting molecule. For certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the twenty-third cell-targeting molecule to a second population of target positive cells as assayed by $CD_{50}$ values. In certain further embodiments, the twenty-third cell-targeting molecule does not comprise any carboxy-terminal, endoplasmic reticulum retention/retrieval signal motif of the KDEL family.

In certain embodiments of Embodiment Sets #1 to #20, the Shiga toxin effector polypeptide further comprises a disruption in the B-cell and/or T-cell epitope region selected from the group of natively positioned Shiga toxin A Subunit regions consisting of; 1-15 of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; and 53-66 of any one of SEQ ID NOs: 1-18; 94-115 of any one of SEQ ID NOs: 1-18; 141-153 of any one of SEQ ID NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18; 240-260 of any one of SEQ ID NOs: 3 and 7-18; 243-257 of any one of SEQ ID NOs: 1-2 and 4-6; 254-268 of any one of SEQ ID NOs: 1-2 and 4-6; 262-278 of any one of SEQ ID NOs: 3 and 7-18; 281-297 of any one of SEQ ID NOs: 3 and 7-18; and 285-293 of any one of SEQ ID NOs: 1-2 and 4-6; or the equivalent region in a Shiga toxin A Subunit or derivative thereof. In certain further embodiments, there is no disruption which is a carboxy-terminal truncation of amino acid residues that overlap with part or all of at least one disrupted, endogenous, B-cell and/or T-cell epitope and/or epitope region.

In certain embodiments of Embodiment Sets #1 to #20, the Shiga toxin effector polypeptide further comprises a mutation, relative to a wild-type Shiga toxin A Subunit, in the B-cell immunogenic, amino acid residue selected from the group of natively positioned Shiga toxin A Subunit amino acid residues: L49, D197, D198, R204, and R205.

In certain embodiments of Embodiment Sets #1 to #20, the embedded or inserted, heterologous, T-cell epitope disrupts the endogenous, B-cell and/or T-cell epitope region is selected from the group of natively positioned Shiga toxin A Subunit regions consisting of: (i) 1-IS of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; and 53-66 of any one of SEQ ID NOs: 1-18, or the equivalent region in a Shiga toxin A Subunit or derivative thereof; (ii) 94-115 of any one of SEQ ID NOs: 1-18; 141-153 of any one of SEQ ID NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18, or the equivalent region in a Shiga toxin A Subunit or derivative thereof; and (iii) 240-260 of any one of SEQ ID NOs: 3 and 7-18; 243-257 of any one of SEQ ID NOs: 1-2 and 4-6; 254-268 of any one of SEQ ID NOs: 1-2 and 4-6; 262-278 of any one of SEQ ID NOs: 3 and 7-18; 281-297 of any one of SEQ ID NOs: 3 and 7-18; and 285-293 of any one of SEQ ID NOs: 1-2 and 4-6, or the equivalent region in a Shiga toxin A Subunit or derivative thereof.

In certain embodiments of Embodiment Sets #1 to #20, the Shiga toxin effector polypeptide comprises a mutation, relative to a wild-type Shiga toxin A Subunit, in the B-cell and/or T-cell epitope region selected from the group of natively positioned Shiga toxin A Subunit regions consisting of: (i) 1-15 of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; and 53-66 of any one of SEQ ID NOs: 1-18, or the equivalent region in a Shiga toxin A Subunit or derivative thereof, wherein there is no disruption which is an amino-terminal truncation of sequences that overlap with part or all of at least one disrupted epitope region; (ii) 94-115 of any one of SEQ ID NOs: 1-18; 141-153 of any one of SEQ ID NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18, or the equivalent region in a Shiga toxin A Subunit or derivative thereof, wherein there is no disruption which is an amino-terminal truncation of sequences that overlap with part or all of at least one disrupted epitope region.

In certain embodiments of Embodiment Sets #1 to #20, the Shiga toxin effector polypeptide comprises a disruption of at least one endogenous epitope region selected from the group of natively positioned Shiga toxin A Subunits consisting of: (ii) 94-115 of any one of SEQ ID NOs: 1-18; 141-153 of any one of SEQ ID NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18, or the equivalent region in a Shiga toxin A Subunit or derivative thereof.

In certain embodiments of Embodiment Sets #2 to #11, the Shiga toxin effector polypeptide does not comprise a heterologous, MHC class I-restricted, T-cell epitope. MHC class I-restricted, T-cell epitopes are known in the art or can be predicted by the skilled worker. The term heterologous refers to MHC class I-restricted, T-cell epitopes which are not natively present in wild-type Shiga toxin A Subunits, such as, e.g., the wild-type Shiga toxin A Subunit which is most closely related to the Shiga toxin effector polypeptide of interest.

In certain embodiments of Embodiment Sets #1 to #20, the Shiga toxin effector polypeptide comprises disruptions of at least four, five, six, seven, eight, or more endogenous, B-cell and/or T-cell epitope regions.

In certain embodiments of Embodiment Sets #1 to #20, one or more disruptions comprises an amino acid residue substitution relative to a wild-type Shiga toxin A Subunit.

In certain embodiments of Embodiment Sets #1 to #20, one or more endogenous, B-cell and/or T-cell epitope regions comprises a plurality of amino acid residue substitutions relative to a wild-type Shiga toxin A Subunit.

In certain embodiments of Embodiment Sets #1 to #20, at least one, two, three, or four disruptions comprise a plurality of amino acid residue substitutions in the endogenous, B-cell and/or T-cell epitope region relative to a wild-type Shiga toxin A Subunit.

In certain embodiments of Embodiment Sets #1 to #20, at least one disruption comprises at least one, two, three, four, five, six, seven, eight, or more amino acid residue substitutions relative to a wild-type Shiga toxin A Subunit, and optionally wherein at least one substitution occurs at the natively positioned Shiga toxin A Subunit amino acid residue selected form the group consisting of: 1 of SEQ ID NO: 1 or SEQ ID NO:2; 4 of SEQ ID NO: 1, SEQ ID NO:2, or SEQ ID NO:3; 6 of SEQ ID NO:1, SEQ ID NO:2, or SEQ ID NO:3; 8 of SEQ ID NO:1, SEQ ID NO:2, or SEQ ID NO:3; 9 of SEQ ID NO:1, SEQ ID NO:2, or SEQ ID NO:3; 11 of SEQ ID NO:1, SEQ ID NO:2, or SEQ ID NO:3; 12 of SEQ ID NO:1, SEQ ID NO:2, or SEQ ID NO:3; 33 of SEQ ID NO:1 or SEQ ID NO:2; 43 of SEQ ID NO:1 or SEQ ID NO:2; 44 of SEQ ID NO:1 or SEQ ID NO:2; 45 of SEQ ID NO:1 or SEQ ID NO:2; 46 of SEQ ID NO:1, SEQ ID NO:2, or SEQ ID NO:3; 47 of SEQ ID NO:1 or SEQ ID NO:2; 48 of SEQ ID NO:1, SEQ ID NO:2, or SEQ ID NO:3; 49 of SEQ ID NO:1, SEQ ID NO:2, or SEQ ID NO:3; 50 of SEQ ID NO:1 or SEQ ID NO:2; 51 of SEQ ID NO:1 or SEQ ID NO:2; 53 of SEQ ID NO:1 or SEQ ID NO:2; 54 of SEQ ID NO:1, SEQ ID NO:2, or SEQ ID NO:3; 55 of SEQ ID NO:1 or SEQ ID NO:2; 56 of SEQ ID NO:1, SEQ ID NO:2, or SEQ ID NO:3; 57 of SEQ ID NO:1, SEQ ID NO:2, or SEQ ID NO:3; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 84 of SEQ ID NO:1 or SEQ ID NO:2; 88 of SEQ ID NO:1, SEQ ID NO:2, or SEQ ID NO:3; 94 of SEQ ID NO:1, SEQ ID NO:2, or SEQ ID NO:3; 96 of SEQ ID NO:1, SEQ ID NO:2, or SEQ ID NO:3; 104 of SEQ ID NO:1 or SEQ ID NO:2; 105 of SEQ ID NO:1 or SEQ ID NO:2; 107 of SEQ ID NO:1, SEQ ID NO:2, or SEQ ID NO:3; 108 of SEQ ID NO:1 or SEQ ID NO:2; 109 of SEQ ID NO:1, SEQ ID NO:2, or SEQ ID NO:3; 110 of SEQ ID NO:1 or SEQ ID NO:2; 111 of SEQ ID NO:1, SEQ ID NO:2, or SEQ ID NO:3; 112 of SEQ ID NO:1, SEQ ID NO:2, or SEQ ID NO:3; 141 of SEQ ID NO:1, SEQ ID NO:2, or SEQ ID NO:3; 147 of SEQ ID NO:1, SEQ ID NO:2, or SEQ ID NO:3; 154 of SEQ ID NO:1 or SEQ ID NO:2; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 197 of SEQ ID NO:3; 198 of SEQ ID NO:1 or SEQ ID NO:2; 204 of SEQ ID NO:3; 205 of SEQ ID NO:1 or SEQ ID NO:2; 247 of SEQ ID NO:1 or SEQ ID NO:2; 247 of SEQ ID NO:3; 248 of SEQ ID NO:1 or SEQ ID NO:2; 250 of SEQ ID NO:3; 251 of SEQ ID NO:1 or SEQ ID NO:2; 264 of SEQ ID NO: 1, SEQ ID NO:2, or SEQ ID NO:3; 265 of SEQ ID NO:1 or SEQ ID NO:2; and 286 of SEQ ID NO: 1 or SEQ ID NO:2; or the equivalent amino acid residue in a Shiga toxin A Subunit or derivative thereof. In certain further embodiments, at least two disruptions each comprise at least one amino acid residue substitutions relative to a wild-type Shiga toxin A Subunit selected form the group consisting of: 1 of SEQ ID NO:1 or SEQ ID NO:2; 4 of SEQ ID NO:1, SEQ ID NO:2, or SEQ ID NO:3; 8 of SEQ ID NO:1, SEQ ID NO:2, or SEQ ID NO:3; 9 of SEQ ID NO:1, SEQ ID NO:2, or SEQ ID NO:3; 11 of SEQ ID NO:1, SEQ ID NO:2, or SEQ ID NO:3; 33 of SEQ ID NO:1 or SEQ ID NO:2; 43 of SEQ ID NO:1 or SEQ ID NO:2; 45 of SEQ ID NO:1 or SEQ ID NO:2; 47 of SEQ ID NO:1 or SEQ ID NO:2; 48 of SEQ ID NO:1, SEQ ID NO:2, or SEQ ID NO:3; 49 of SEQ ID NO:1 or SEQ ID NO:2; 53 of SEQ ID NO:1 or SEQ ID NO:2; 55 of SEQ ID NO:1 or SEQ ID NO:2; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 94 of SEQ ID NO:1, SEQ ID NO:2, or SEQ ID NO:3; 96 of SEQ ID NO:1, SEQ ID NO:2, or SEQ ID NO:3; 109 of SEQ ID NO:1, SEQ ID NO:2, or SEQ ID NO:3; 110 of SEQ ID NO:1 or SEQ ID NO:2; 112 of SEQ ID NO: 1, SEQ ID NO:2, or SEQ ID NO:3; 147 of SEQ ID NO: 1, SEQ ID NO:2, or SEQ ID NO:3; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID NO:2, or SEQ ID NO:3; 184 of SEQ ID NO: 1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 204 of SEQ ID NO:3; 205 of SEQ ID NO:1 or SEQ ID NO:2; 247 of SEQ ID NO:1 or SEQ ID NO:2; 247 of SEQ ID NO:3; 250 of SEQ ID NO:3; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2; or the equivalent amino acid residue in a Shiga toxin A Subunit or derivative thereof.

In certain embodiments of Embodiment Sets #1 to #20, the Shiga toxin effector polypeptide comprises disruption of at least three, endogenous, B-cell and/or T-cell epitope regions selected from the group of consisting of: (i) 1-15 of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; and 53-66 of any one of SEQ ID NOs: 1-18, or the equivalent region in a Shiga toxin A Subunit or derivative thereof, wherein there is no disruption which is an amino-terminal truncation of amino acid residues that overlap with part or all of at least one disrupted, endogenous, B-cell and/or T-cell epitope region; (ii) 94-115 of any one of SEQ ID NOs: 1-18; 141-153 of any one of SEQ ID NOs: 1-2 and 4-6; 140-156 of any one of SEQ ID NOs: 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18, or the equivalent region in a Shiga toxin A Subunit or derivative thereof, wherein there is no disruption which is a carboxy-terminal truncation of amino acid residues that overlap with part or all of at least one disrupted, endogenous, B-cell and/or T-cell epitope and/or epitope region.

In certain embodiments of Embodiment Sets #1 to #20, the Shiga toxin effector polypeptide comprises disruptions of at least two, endogenous, B-cell and/or T-cell epitope regions, wherein each disruption comprises one or more amino acid residue substitutions, and wherein the endogenous, B-cell and/or T-cell epitope regions are selected from the group of natively positioned Shiga toxin A Subunit regions consisting of: 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; 53-66 of any one of SEQ ID NOs: 1-18; or the equivalent region in a Shiga toxin A Subunit or derivative thereof.

In certain embodiments of Embodiment Sets #1 to #20, the embedded or inserted, heterologous, T-cell epitope does not disrupt any endogenous, B-cell and/or CD4+ T-cell epitope region described herein.

In certain embodiments of Embodiment Sets #1 to #20, at least one disruption comprises one or more amino acid residue substitutions relative to a wild-type Shiga toxin A Subunit is selected from the group consisting of: D to A, D to G, D to V, D to L, D to I, D to F, D to S, D to Q, D to M, D to R, E to A, E to G, E to V, E to L, E to I, E to F, E to S, E to Q, E to N, E to D, E to M, E to R, F to A, F to G, F to V, F to L, F to I, G to A, G to P, H to A, H to G, H to V, H to L, H to I, H to F, H to M, I to A, I to V, I to G, I to C, K to A, K to G, K to V, K to L, K to I, K to M, K to H, L to A, L to V, L to G, L to C, N to A, N to G, N to V, N to L, N to I, N to F, P to A, P to G, P to F, R to A, R to G, R to V, R to L, R to I, R to F, R to M, R to Q, R to S, R to K, R to H, S to A, S to G, S to V, S to L, S to I, S to F, S to M, T to A, T to G, T to V, T to L, T to I, T to F, T to M, T to S, V to A, V to G, Y to A, Y to G, Y to V, Y to L, Y to I, Y to F, Y to M, and Y to T. In certain further embodiments, the one or more amino acid residue substitutions relative to a wild-type Shiga toxin A Subunit is selected from the group consisting of: D to A, D to G, D to V, D to L, D to I, D to F, D to S, D to Q, E to A, E to G, E to V, E to L, E to I, E to F, E to S, E to Q, E to N, E to D, E to M, E to R, G to A, H to A, H to G, H to V, H to L, H to I, H to F, H to M, K to A, K to G, K to V, K to L, K to I, K to M, K to H, L to A, L to G, N to A, N to G, N to V, N to L, N to I, N to F, P to A, P to G, P to F, R to A, R to G, R to V, R to L, R to I, R to F, R to M, R to Q, R to S, R to K, R to H, S to A, S to G, S to V, S to L, S to I, S to F, S to M, T to A, T to G, T to V, T to L, T to I, T to F, T to M, T to S, Y to A, Y to G, Y to V, Y to L, Y to I, Y to F, and Y to M.

In certain embodiments of Embodiment Sets #1 to #20, at least one of the disruption(s) comprises one or more amino acid residue substitutions relative to a wild-type Shiga toxin A Subunit selected from the group consisting of; K1 to A, G, V, L, I, F, M and H; T4 to A, G, V, L, I, F, M, and S; D6 to A, G, V, L, I, F, S, Q and R; S8 to A, G, V, I, L, F, and M; T9 to A, G, V, I, L, F, M, and S; S9 to A, G, V, L, I, F, and M; K11 to A, G, V, L, I, F, M and H; T12 to A, G, V, I, L, F, M, S, and K; S12 to A, G, V, I, L, F, and M; S33 to A, G, V, L, I, F, M, and C; S43 to A, G, V, L, I, F, and M; G44 to A or L; S45 to A, G, V, L, I, F, and M; T45 to A, G, V, L, I, F, and M; G46 to A and P; D47 to A, G, V, L, T, F, S, M, and Q; N48 to A, G, V, L, M and F; L49 to A, V, C, and G; Y49 to A, G, V, L, I, F, M, and T; F50 to A, G, V, L, I, and T; A51; D53 to A, G, V, L, I, F, S, and Q; V54 to A, G, I, and L; R55 to A, G, V, L, I, F, M, Q, S, K, and H; G56 to A and P; I57 to A, G, V, and M; L57 to A, V, C, G, M, and F; D58 to A, G, V, L, I, F, S, and Q; P59 to A, G, and F; E60 to A, G, V, L, I, F, S, Q, N, D, M, T, and R; E61 to A, G, V, L, I, F, S, Q, N, D, M, and R; G62 to A; R84 to A, G, V, L, I, F, M, Q, S, K, and H; V88 to A and G; I88 to A, V, C, and G; D94 to A, G, V, L, I, F, S, and Q; S96 to A, G, V, I, L, F, and M; T104 to A, G, V, L, I, F, M; and N; A105 to L; T107 to A, G, V, L, I, F, M, and P; S107 to A, G, V, L, I, F, M, and P; L108 to A, V, C, and G; S109 to A, G, V, I, L, F, and M; T109 to A, G, V, I, L, F, M, and S; G110 to A; S112 to A, G, V, L, I, F, and M; D111 to A, G, V, L, I, F, S, Q, and T; S112 to A, G, V, L, I, F, and M; D141 to A, G, V, L, I, F, S, and Q; G147 to A; V154 to A and G. R179 to A, G, V, L, I, F, M, Q, S, K, and H; T180 to A, G, V, L, I, F, M, and S; T181 to A, G, V, L, I, F, M, and S; D183 to A, G, V, L, I, F, S, and Q; D184 to A, G, V, L, I, F, S, and Q; L185 to A, G, V and C; S186 to A, G, V, T, L, F, and M; G187 to A; R188 to A, G, V, L, I, F, M, Q, S, K, and H; S189 to A, G, V, I, L, F, and M; D197 to A, G, V, L, I, F, S, and Q; D198 to A, G, V, L, I, F, S, and Q; R204 to A, G, V, L, I, F, M, Q, S, K, and H; R205 to A, G, V, L, I, F, M, Q, S, K and H; S247 to A, G, V, I, L, F, and M; Y247 to A, G, V, L, I, F, and M; R248 to A, G, V, L, I, F, M, Q, S, K, and H; R250 to A, G, V, L, I, F, M, Q, S, K, and H; R251 to A, G, V, L, I, F, M, Q, S, K, and H; D264 to A, G, V, L, I, F, S, and Q; G264 to A; and T286 to A, G, V, L, I, F, M, and S.

For certain embodiments of Embodiment Sets #1 to #20, the cell-targeting molecule of the present invention is capable when introduced to a chordate of exhibiting improved in vivo tolerability and/or stability compared to a reference molecule, such as, e.g., a twenty-fourth cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region. In certain further embodiments, the Shiga toxin effector polypeptide is not cytotoxic and the molecular moiety is cytotoxic.

In certain embodiments of Embodiment Sets #1 to #20, the binding region and Shiga toxin effector polypeptide are linked together, either directly or indirectly.

In certain embodiments of Embodiment Sets #1 to #20, the binding region comprises at least one peptide and/or polypeptide. In certain further embodiments, the binding region is or comprises an immunoglobulin-type binding region. In certain further embodiments, the binding region comprising a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality.

For certain embodiments of Embodiment Sets #1 to #20, the cell-targeting molecule of the present invention is capable of exhibiting (i) a catalytic activity level comparable to a wild-type Shiga toxin A1 fragment or wild-type Shiga toxin effector polypeptide, (ii) a ribosome inhibition activity with a half-maximal inhibitory concentration ($IC_{50}$) value of 10,000 picomolar or less, and/or (iii) a significant level of Shiga toxin catalytic activity.

For certain embodiments of Embodiment Sets #1 to #20, the cell-targeting molecule of the present invention and/or its Shiga toxin effector polypeptide is capable of exhibiting subcellular routing efficiency comparable to a reference cell-targeting molecule comprising a wild-type Shiga toxin A1 fragment or wild-type Shiga toxin effector polypeptide and/or capable of exhibiting a significant level of intracellular routing activity to the endoplasmic reticulum and/or cytosol from an endosomal starting location of a cell.

For certain embodiments of Embodiment Sets #1 to #20, whereby administration of the cell-targeting molecule of the present invention to a cell physically coupled with the extracellular target biomolecule of the cell-targeting molecule's binding region, the cell-targeting molecule is capable of causing death of the cell. In certain further embodiments, administration of the cell-targeting molecule of the invention to two different populations of cell types which differ with respect to the presence or level of the extracellular target biomolecule, the cell-targeting molecule is capable of causing cell death to the cell-types physically coupled with an extracellular target biomolecule of the cytotoxic cell-targeting molecule's binding region at a $CD_{50}$ at least three times or less than the $CD_{50}$ to cell types which are not physically coupled with an extracellular target biomolecule of the cell-targeting molecule's binding region. For certain embodiments, whereby administration of the cell-targeting molecule of the present invention to a first populations of cells whose members are physically coupled to extracellular target biomolecules of the cell-targeting molecule's binding region, and a second population of cells whose members are not physically coupled to any extracellular target biomolecule of the binding region, the cytotoxic effect of the cell-targeting molecule to members of said first population of cells relative to members of said second population of cells is at least 3-fold greater. For certain embodiments, whereby administration of the cell-targeting molecule of the present invention to a first populations of cells whose members are physically coupled to a significant amount of the extracellular target biomolecule of the cell-targeting molecule's binding region, and a second population of cells whose members are not physically coupled to a significant amount of any extracellular target biomolecule of the binding region, the cytotoxic effect of the cell-targeting molecule to members of said first population of cells relative to members of said second population of cells is at least 3-fold greater. For certain embodiments, whereby administration of the cell-targeting molecule of the present invention to a first population of target biomolecule positive cells, and a second population of cells whose members do not express a significant amount of a target biomolecule of the cell-targeting molecule's binding region at a cellular surface, the cytotoxic effect of the cell-targeting molecule to members of the first population of cells relative to members of the second population of cells is at least 3-fold greater.

For certain embodiments of Embodiment Sets #1 to #20, the cell-targeting molecule of the present invention is capable when introduced to cells of exhibiting a cytotoxicity with a half-maximal inhibitory concentration ($CD_{50}$) value of 300 nM or less and/or capable of exhibiting a significant level of Shiga toxin cytotoxicity.

For certain embodiments of Embodiment Sets #1 to #20, the cell-targeting molecule of the present invention is capable of delivering an embedded or inserted, heterologous, CD8+ T-cell epitope to a MHC class I presentation pathway of a cell for cell-surface presentation of the epitope bound by a MHC class I molecule.

In certain embodiments of Embodiment Sets #1 to #20, the cell-targeting molecule comprises a molecular moiety associated with the carboxy-terminus of the Shiga toxin effector polypeptide. In certain embodiments, the molecular moiety comprises or consists of the binding region. In certain embodiments, the molecular moiety comprises at least one amino acid and the Shiga toxin effector polypeptide is linked to at least one amino acid residue of the molecular moiety. In certain further embodiments, the molecular moiety and the Shiga toxin effector polypeptide are fused forming a continuous polypeptide.

In certain embodiments of Embodiment Sets #1 to #20, the cell-targeting molecule further comprises a cytotoxic molecular moiety associated with the carboxy-terminus of the Shiga toxin effector polypeptide. For certain embodiments, the cytotoxic molecular moiety is a cytotoxic agent, such as, e.g., a small molecule chemotherapeutic agent, anti-neoplastic agent, cytotoxic antibiotic, alkylating agent, antimetabolite, topoisomerase inhibitor, and/or tubulin inhibitor known to the skilled worker and/or described herein. For certain further embodiments, the cytotoxic molecular moiety is cytotoxic at concentrations of less than 10,000, 5,000, 1,000, 500, or 200 pM.

In certain embodiments of Embodiment Sets #1 to #20, the binding region is capable of binding to an extracellular target biomolecule selected from the group consisting of: CD20, CD22, CD40, CD74, CD79, CD25, CD30, HER2/neu/ErbB2, EGFR, EpCAM, EphB2, prostate-specific membrane antigen, Cripto, CDCP1, endoglin, fibroblast activated protein, Lewis-Y, CD19, CD21, CS1/SLAMF7, CD33, CD52, CD133, CEA, gpA33, mucin, TAG-72, tyrosine-protein kinase transmembrane receptor (ROR1 or NTRKR1), carbonic anhydrase IX, folate binding protein, ganglioside GD2, ganglioside GD3, ganglioside GM2, ganglioside Lewis-Y2, VEGFR, Alpha V beta3, Alpha5beta1, ErbB1/EGFR, Erb3, c-MET, IGF1R, EphA3, TRAIL-R1, TRAIL-R2, RANK, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, HPV-E7, Epstein-Barr virus antigen, Bcr-Abl, alpha-fetoprotein antigen, 17-A1, bladder tumor antigen, SAIL, CD38, CD15, CD23, CD45 (protein tyrosine phosphatase receptor type C), CD53, CD88, CD129, CD183, CD191, CD193, CD244, CD294, CD305, C3AR, FceRIa, galectin-9, IL-1R (interleukin-1 receptor), mrp-14, NKG2D ligand, programmed death-ligand 1 (PD-L1), Siglec-8, Siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC class I molecule, MHC class II molecule (optionally complexed with a peptide), CD284 (TLR4), CD107-Mac3, CD195 (CCR5), HLA-DR, CD16/32, CD282 (TLR2), CD11c, and any immunogenic fragment of any of the foregoing.

In certain embodiments of Embodiment Sets #1 to #20, the binding region is linked, either directly or indirectly, to the Shiga toxin effector polypeptide by at least one covalent bond which is not a disulfide bond. In certain further embodiments, the binding region is fused, either directly or indirectly, to the carboxy-terminus of the Shiga toxin effector polypeptide to form a single, continuous polypeptide. In certain further embodiments, the binding region is an immunoglobulin-type binding region.

In certain embodiments of Embodiment Sets #1 to #20, the disrupted furin-cleavage motif comprises one or more mutations in the minimal, furin-cleavage site relative to a wild-type Shiga toxin A Subunit. In certain embodiments, the disrupted furin-cleavage motif is not an amino-terminal truncation of sequences that overlap with part or all of at least one amino acid residue of the minimal furin-cleavage site. In certain embodiments, the mutation in the minimal, furin-cleavage site is an amino acid deletion, insertion, and/or substitution of at least one amino acid residue in the R/Y-x-x-R furin cleavage motif. In certain further embodiments, the disrupted furin-cleavage motif comprises at least one mutation relative to a wild-type Shiga toxin A Subunit, the mutation altering at least one amino acid residue in the region natively positioned at 248-251 of the A Subunit of Shiga toxin (SEQ ID NOs: 1-2 and 4-6), or at 247-250 of the A Subunit of Shiga-like toxin 2 (SEQ ID NOs: 3 and 7-18), or the equivalent amino acid sequence position in any Shiga toxin A Subunit. In certain further embodiments, the mutation is an amino acid residue substitution of an arginine residue with a non-positively charged, amino acid residue.

In certain embodiments of Embodiment Sets #1 to #20, the cell-targeting molecule of the present invention is capable when introduced to cells of exhibiting cytotoxicity comparable to a cytotoxicity of a reference molecule, such as, e.g., a twenty-fifth cell-targeting molecule consisting of the cell-targeting molecule except for all of its Shiga toxin effector polypeptide component(s) each comprise a wild-type Shiga toxin A1 fragment.

In certain embodiments of Embodiment Sets #1 to #20, one or more binding region(s) comprises the peptide or polypeptide shown in any one of SEQ ID NOs: 39-245.

In certain embodiments of Embodiment Sets #11 to #20, two or more binding regions comprise the peptide or polypeptide shown in any one of SEQ ID NOs: 39-245. In certain further embodiments of Embodiment Sets #11 to #20, two or more binding regions each comprise the same peptide or polypeptide shown in any one of SEQ ID NOs: 39-245.

Certain embodiments of the cell-targeting molecule of the present invention comprises any one of SEQ ID NOs: 19-255, 259-278, and 288-748.

Certain embodiments of the cell-targeting molecule of the present invention comprise or consist essentially of the polypeptide represented by the amino acid sequence shown in any one of SEQ ID NOs: 252-255, 259-278, and 288-748.

In certain embodiments of Embodiment Sets #1 to #20, at least one binding region sterically covers the carboxy-terminus of the A1 fragment region.

In certain embodiments of Embodiment Sets #1 to #20, the molecular moiety sterically covers the carboxy-terminus of the A1 fragment region. In certain further embodiments, the molecular moiety comprises the binding region.

In certain embodiments of Embodiment Sets #1 to #20, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Sets #1 to #20, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Sets #1 to #20, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

For certain embodiments of Embodiment Sets #1 to #20, the cell-targeting molecule of the present invention exhibits low cytotoxic potency (i.e. is not capable when introduced to certain positive target cell types of exhibiting a cytotoxicity greater than 1% cell death of a cell population at a cell-targeting molecule concentration of 1000 nM, 500 nM, 100 nM, 75 nM, or 50 nM) and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., a twenty-sixth cell-targeting molecule having an amino-terminus and comprising the binding region and the Shiga toxin effector polypeptide which is not positioned at or proximal to the amino-terminus of the third cell-targeting molecule. In certain further embodiments, the twenty-sixth cell-targeting molecule does not comprise any carboxy-terminal, endoplasmic reticulum retention/retrieval signal motif of the KDEL family.

In certain embodiments of Embodiment Sets #1 to #20, In certain further embodiments, the molecular moiety comprises a peptide and/or polypeptide derived from the Shiga toxin A2 fragment of a naturally occurring Shiga toxin.

The embodiments of the present invention are not intended to cover any naturally-occurring Shiga holotoxin or Shiga toxin A Subunit. In certain embodiments of Embodiment Sets #1 to #20, the cell-targeting molecule of the present invention does not comprise a naturally occurring Shiga toxin B Subunit. In certain further embodiments, the cell-targeting molecule of the invention does not comprise any polypeptide comprising or consisting essentially of a functional binding domain of a native Shiga toxin B subunit. Rather, in certain embodiments of the cell-targeting molecules of the invention, the Shiga toxin A Subunit derived regions are functionally associated with heterologous binding regions to effectuate cell-targeting.

In certain embodiments of Embodiment Sets #1 to #20, the cell-targeting molecule of the present invention is limited by the proviso that the heterologous, CD8+ T-cell epitope-peptide cargo does not comprise or consist of the polypeptide shown in SEQ ID NO:25 for all variations described above of Embodiment Sets #1 to #20. In certain embodiments of Embodiment Sets #1 to #20, the cell-targeting molecule of the present invention is limited by the proviso that the cell-targeting molecule of the present invention does not comprise the Shiga toxin effector polypeptide comprising the CD8+ T-cell epitope-peptide GILGFVFTL (SEQ ID NO:25) embedded at native position 53 in SLT-1A (SEQ ID NO: 1) for all variations described above of Embodiment Sets #1 to #20. In certain embodiments of Embodiment Sets #1 to #20, the cell-targeting molecule of the present invention is limited by the proviso that the cell-targeting molecule of the present invention does not comprise the polypeptide shown in SEQ ID NO:25 for all variations described above of Embodiment Sets #1 to #20. In certain embodiments of Embodiment Sets #1 to #20, the cell-targeting molecule of the present invention is limited by the proviso that the cell-targeting molecule of the present invention does not comprise any Shiga toxin effector polypeptide comprising any embedded or inserted, CD8+ T-cell epitope for all variations described above of Embodiment Sets #1 to #20.

In certain embodiments of Embodiment Sets #1 to #20, the cell-targeting molecule of the present invention is limited by the proviso that the cell-targeting molecule of the present invention does not comprise the linker shown in SEQ ID NO:247 wherein the linker is fused, either directly or indirectly, between a binding region and a Shiga toxin effector polypeptide and wherein the binding region is positioned amino-terminal to the Shiga toxin effector polypeptide for all variations described above of Embodiment Sets #1 to #20. In certain embodiments of Embodiment Sets #1 to #20, the cell-targeting molecule of the present invention is limited by the proviso that the cell-targeting molecule of the present invention does not comprise the linker shown in SEQ ID NO:247 wherein the linker is fused between a binding region and a Shiga toxin effector polypeptide for all variations described above of Embodiment Sets #1 to #20.

In certain embodiments of Embodiment Sets #1 to #20, the cell-targeting molecule of the present invention is limited by the proviso that the cell-targeting molecule of the present invention does not comprise or consist essentially of the polypeptide shown in any one of SEQ ID NOs: 259-278 and 287 for all variations described above of Embodiment Sets #1 to #20.

In certain embodiments of Embodiment Sets #1 to #20, the cell-targeting molecule of the present invention does not comprise any heterologous, CD8+ T-cell epitope-peptide cargo fused between a binding region and a Shiga toxin effector polypeptide wherein the binding region is positioned amino-terminal to the Shiga toxin effector. In certain embodiments, the cell-targeting molecule of the present invention does not comprise any heterologous, CD8+ T-cell epitope-peptide cargo fused between a binding region and a Shiga toxin effector polypeptide.

For certain embodiments of Embodiment Sets #1 to #20, the target cell is not a professional antigen presenting cell, such as a dendritic cell type. For certain embodiments of the cell-targeting molecule of the present invention, the extracellular target biomolecule of the binding region is not expressed by a professional antigen presenting cell. For certain embodiments of the cell-targeting molecule of the present invention, the extracellular target biomolecule of the binding region is not physically associated in significant quantities with a professional antigen presenting cell. For certain embodiments of the cell-targeting molecule of the present invention, the extracellular target biomolecule of the binding region is not physically associated with a professional antigen presenting cell. For certain embodiments of the cell-targeting molecules of the present invention, the target biomolecule of the binding region is not expressed in significant amounts on the cellular surface of any professional antigen presenting cell within the chordate subject to be treated.

In certain embodiments of Embodiment Sets #1 to #20, the heterologous, CD8+ T-cell epitope-peptide cargo is not directly associated with any amino acid residue of the Shiga toxin A1 fragment derived region of the Shiga toxin effector polypeptide. In certain embodiments of the cell-targeting molecule of the present invention, the heterologous, CD8+ T-cell epitope-peptide cargo is not directly associated with any internal amino acid residue of the Shiga toxin effector polypeptide, meaning either the amino- or carboxy-terminal amino acid residue of the Shiga toxin effector polypeptide may be directly linked to a heterologous, CD8+ T-cell epitope-peptide cargo.

In certain embodiments of Embodiment Sets #1 to #20, the binding region does not comprise a fragment of human CD4 corresponding to amino acid residues 19-183. In certain further embodiments, the binding region does not comprise a fragment of human CD4, a type-I transmembrane glycoprotein. In certain further embodiments, the binding region does not comprise a fragment of a human, immune cell surface co-receptor.

In certain embodiments of Embodiment Sets #1 to #20, the cell-targeting molecule of the present invention does not comprise a carboxy-terminal, binding region comprising a fragment of an immune cell surface receptor.

In certain embodiments of Embodiment Sets #1 to #20, the Shiga toxin effector polypeptide comprises at least two, embedded or inserted, heterologous epitopes.

In certain embodiments of Embodiment Sets #1 to #20, the Shiga toxin effector polypeptide does not comprise the set of amino acid residue substitutions relative to a wild-type Shiga toxin A Subunit selected from the following sets: (1) R248H and R251H; (2) R248G and R251G; (3) A246G, S247A, A253G, and S254A; and (4) A246G, S247A, R248G, R251G, A253G, and S254A.

In certain embodiments of Embodiment Sets #1 to #20, the Shiga toxin effector polypeptide does not comprise a deletion of the region natively positioned at 247-252 in a wild-type Shiga toxin A Subunit. In certain embodiments of Embodiment Sets #1 to #20, the Shiga toxin effector polypeptide does not comprise deletions of the regions natively positioned at 245-247 and 253-255 in a wild-type Shiga toxin A Subunit.

In certain embodiments of Embodiment Sets #1 to #20, the Shiga toxin effector polypeptide comprises one or more mutations relative to a naturally occurring A Subunit of a member of the Shiga toxin family which changes an enzymatic activity of the Shiga toxin effector polypeptide, the mutation selected from at least one amino acid residue deletion, insertion, or substitution. In certain further embodiments, the mutation relative to the naturally occurring A Subunit reduces of eliminates a cytotoxic activity of the Shiga toxin effector polypeptide but the Shiga toxin effector polypeptide retains at least one other Shiga toxin effector function, such as, e.g., promoting cellular internalization and/or directing intracellular routing to a certain subcellular compartment(s). In certain further embodiments, the mutation relative to the naturally occurring A Subunit is selected from at least one amino acid residue substitution, such as, e.g., A231E, N75A, Y77S, Y114S, E167D, R170A, R176K, W202A, and/or W203A in SEQ ID NO:1-18.

For certain embodiments of Embodiment Sets #1 to #20, the Shiga toxin effector polypeptide is capable of: (i) routing to a subcellular compartment of a cell in which the Shiga toxin effector polypeptide is present selected from the following: cytosol, endoplasmic reticulum, and lysosome; (ii) intracellular delivery of the epitope-cargo from an early endosomal compartment to a proteasome of a cell in which the Shiga toxin effector polypeptide is present; and/or (iii) intracellular delivery of the epitope to a MHC class I molecule from an early endosomal compartment of a cell in which the Shiga toxin effector polypeptide is present. In certain further embodiments, the Shiga toxin effector polypeptide is capable of intracellular delivery of the CD8+ T-cell epitope for presentation by a MHC class I molecule on the surface of a cell in which the Shiga toxin effector polypeptide is present.

In certain embodiments, the molecule of the present invention does not comprise, at a position carboxy-terminal of the Shiga toxin effector polypeptide and/or the carboxy-terminus of the Shiga toxin A1 fragment region, any additional exogenous material representing an antigen and/or heterologous, CD8+, T-cell epitope-peptide cargo.

In certain embodiments of Embodiment Sets #1 to #20, the binding region does not comprise a ligand. In certain embodiments of Embodiment Sets #1 to #20, the binding region does not comprise a chemokine or a TNF-related apoptosis-inducing ligand (TRAIL) nor a receptor binding fragment thereof. In certain embodiments of Embodiment Sets #1 to #20, the binding region does not comprise a human chemokine or human TRAIL nor a receptor binding fragment thereof. In embodiments of Embodiment Sets #1 to

20, the immunoglobulin-type binding region does not comprise a ligand nor a receptor binding fragment thereof. In certain embodiments of Embodiment Sets #1 to #20, the immunoglobulin-type binding region does not comprise a chemokine or a TNF-related apoptosis-inducing ligand (TRAIL) nor a receptor binding fragment thereof. In certain embodiments of Embodiment Sets #1 to #20, the binding region does not comprise a human CC chemokine nor a receptor binding fragment thereof. In certain embodiments of Embodiment Sets #1 to #20, the binding region does not comprise the human CC chemokine CCL2 (see Bose S et al., *Arch Pharm Res* 36: 1039-50 (2013)). In certain embodiments of Embodiment Sets #1 to #20, the binding region does not comprise the human, CC chemokine CCL2, nor a receptor binding fragment thereof, and a carboxy-terminal, Shiga toxin effector polypeptide consisting of amino acids 75-247 of StxA. In certain embodiments of the cell-targeting molecule of the present invention, the binding region does not comprise the human, CC chemokine CCL2, nor a receptor binding fragment thereof, fused to a carboxy-terminal, Shiga toxin effector polypeptide consisting of amino acids 75-247 of StxA (SEQ ID NO:2). In embodiments of Embodiment Sets #1 to #20, the binding region does not comprise the human TRAIL nor a receptor binding fragment thereof.

In certain embodiments, the cell-targeting molecule of the present invention comprises or consists essentially of the polypeptide of any one of SEQ ID NOs: 252-255, 259-278, and 288-748. In certain embodiments, the cell-targeting molecule of the present invention does not comprise SEQ ID NO:25 and/or SEQ ID NO:247. In certain embodiments, the cell-targeting molecule of the present invention does not comprise or consist essentially of SEQ ID NO:287.

In certain embodiments of Embodiment Sets #1 to #20, the cell-targeting molecule of the present invention is limited by the proviso that the cell-targeting molecule of the present invention does not comprise or consist essentially of the polypeptide shown in SEQ ID NO:287 for all variations described above of Embodiment Sets #1 to #20.

The present invention also provides pharmaceutical compositions comprising a cell-targeting molecule of the present invention and at least one pharmaceutically acceptable excipient or carrier; and the use of such a cell-targeting molecule, or a composition comprising it, in methods of the invention as further described herein. Certain embodiments of the present invention are pharmaceutical compositions comprising any cell-targeting molecule of the present invention; and at least one pharmaceutically acceptable excipient or carrier.

Among certain embodiments of the present invention is a diagnostic composition comprising any one of the above cell-targeting molecules of the present invention and a detection promoting agent for the collection of information, such as diagnostically useful information about a cell-type, tissue, organ, disease, disorder, condition, and/or patient. Certain further embodiments are cell-targeting molecules of the present invention wherein the detection promoting agent is a heterologous epitope-peptide cargo and the cell-targeting molecule comprises the heterologous epitope-peptide cargo.

Beyond the cell-targeting molecules and compositions of the present invention, polynucleotides capable of encoding a cell-targeting molecule of the present invention, or a protein component thereof, are within the scope of the present invention, as well as expression vectors which comprise a polynucleotide of the invention and host cells comprising an expression vector of the invention. Host cells comprising an expression vector may be used, e.g., in methods for producing a cell-targeting molecule of the present invention, or a protein component or fragment thereof, by recombinant expression.

The present invention also encompasses any composition of matter of the present invention which is immobilized on a solid substrate. Such arrangements of the compositions of matter of the present invention may be utilized, e.g., in methods of screening molecules as described herein.

Among certain embodiments of the present invention is a method of delivering into a cell a CD8+ T-cell epitope-peptide cargo capable of being presented by a MHC class I molecule of the cell, the method comprising the step of contacting the cell with the cell-targeting molecule of the present invention and/or a composition thereof (e.g., a pharmaceutical or diagnostic composition of the present invention).

Among certain embodiments of the present invention is a method of inducing a cell to present an exogenously administered CD8+ T-cell epitope-peptide cargo complexed to a MHC class I molecule, the method comprising the step of contacting the cell, either in vitro or in vivo, with the cell-targeting molecule of the present invention, which comprises the CD8+ T-cell epitope, and/or a composition thereof (e.g., a pharmaceutical or diagnostic composition of the present invention comprising such a cell-targeting molecule of the present invention).

Among certain embodiments of the present invention is a method of inducing an immune cell-mediated response to target cell via a CD8+ T-cell epitope MHC class I molecule complex, the method comprising the step of contacting the target cell either in vitro or in vivo, with the cell-targeting molecule of the present invention, which comprises the CD8+ T-cell epitope as a cargo, and/or a composition thereof (e.g., a pharmaceutical or diagnostic composition of the present invention comprising such a cell-targeting molecule of the present invention). For certain further embodiments, the immune response is selected from the group consisting: CD8+ immune cell secretion of a cytokine(s), cytotoxic T lymphocyte-(CTL) induced growth arrest in the target cell, CTL-induced necrosis of the target cell, CTL-induced apoptosis of the target cell, immune cell-mediated cell killing of a cell other than the target cell.

Among certain embodiments of the present invention is a method of causing intercellular engagement of a CD8+ immune cell with a target cell, the method comprises the step of contacting the target cell with the cell-targeting molecule of the present invention in the presence of a CD8+ immune cell or with the subsequent step of contacting the target cell with one or more CD8+ immune cells. For certain embodiments, the contacting step occurs in vitro. For certain other embodiments, the contacting step occurs in vivo, such as, e.g., by administering the cell-targeting molecule to a chordate, vertebrate, and/or mammal. For certain embodiments, the intercellular engagement occurs in vitro. For certain embodiments, the intercellular engagement occurs in vivo.

Among certain embodiments of the present invention is a composition comprising a cell-targeting molecule of the present invention for "seeding" a tissue locus within a chordate.

For certain embodiments, a method of the present invention is for "seeding" a tissue locus within a chordate, the method comprising the step of: administering to the chordate a cell-targeting molecule of the present invention, a pharmaceutical composition of the present invention, and/or a diagnostic composition of the present invention. For certain further embodiments, the method is for "seeding" a tissue locus within a chordate which comprises a malignant, diseased, and/or inflamed tissue. For certain further embodiments, the method is for "seeding" a tissue locus within a chordate which comprises the tissue selected from the group consisting of: diseased tissue, tumor mass, cancerous growth, tumor, infected tissue, or abnormal cellular mass. For certain embodiments, the method for "seeding" a tissue locus within a chordate comprises the step of: administering to the chordate a cell-targeting molecule of the present invention comprising the heterologous, CD8+ T-cell epitope-peptide cargo selected from the group consisting of: peptides not natively presented by the target cells of the cell-targeting molecule in MHC class I complexes, peptides not natively present within any protein expressed by the target cell, peptides not natively present within the transcriptome and/or proteome of the target cell, peptides not natively present in the extracellular microenvironment of the site to be seeded, and peptides not natively present in the tumor mass or infected tissue site to be targeted.

Additionally, the present invention provides methods of killing a cell(s) comprising the step of contacting a cell(s) with a cell-targeting molecule of the present invention or a pharmaceutical composition comprising a cell-targeting molecule of the invention. For certain embodiments, the step of contacting the cell(s) occurs in vitro. For certain other embodiments, the step of contacting the cell(s) occurs in vivo. For further embodiments of the cell-killing methods, the method is capable of selectively killing cell(s) and/or cell-types preferentially over other cell(s) and/or cell-types when contacting a mixture of cells which differ with respect to the extracellular presence and/or expression level of an extracellular target biomolecule of the binding region of the cell-targeting molecule.

The present invention further provides methods of treating diseases, disorders, and/or conditions in patients in need thereof comprising the step of administering to a patient in need thereof a therapeutically effective amount of a composition comprising a cell-targeting molecule or pharmaceutical composition of the present invention. For certain embodiments, the disease, disorder, or condition to be treated using this method of the invention is selected from: a cancer, tumor, growth abnormality, immune disorder, or microbial infection. For certain embodiments of this method, the cancer to be treated is selected from the group consisting of: bone cancer, breast cancer, central/peripheral nervous system cancer, gastrointestinal cancer, germ cell cancer, glandular cancer, head-neck cancer, hematological cancer, kidney-urinary tract cancer, liver cancer, lung/pleura cancer, prostate cancer, sarcoma, skin cancer, and uterine cancer. For certain embodiments of this method, the immune disorder to be treated is an immune disorder associated with a disease selected from the group consisting of: amyloidosis, ankylosing spondylitis, asthma, Crohn's disease, diabetes, graft rejection, graft-versus-host disease, Hashimoto's thyroiditis, hemolytic uremic syndrome, HIV-related diseases, lupus erythematosus, multiple sclerosis, polyarteritis nodosa, polyarthritis, psoriasis, psoriatic arthritis, rheumatoid arthritis, scleroderma, septic shock, Sjorgren's syndrome, ulcerative colitis, and vasculitis Among certain embodiments of the present invention is a composition comprising a cell-targeting molecule of the present invention for the treatment or prevention of a cancer, tumor, growth abnormality, immune disorder, or microbial infection. Among certain embodiments of the present invention is the use of a composition of matter of the present invention in the manufacture of a medicament for the treatment or prevention of a cancer, tumor, growth abnormality, immune disorder, or microbial infection.

The use of any composition of the present invention for the treatment or prevention of a cancer, tumor, growth abnormality, and/or immune disorder is within the scope of the present invention.

Certain embodiments of the present invention include a method of treating cancer in a patient using immunotherapy, the method comprising the step of administering to the patient in need thereof the cell-targeting molecule and/or pharmaceutical composition of the present invention.

The use of any composition of matter of the present invention for the treatment or prevention of a cancer, tumor, growth abnormality, and/or immune disorder is within the scope of the present invention. Among certain embodiments of the present invention is a cell-targeting molecule of the present invention and/or a pharmaceutical composition thereof for the treatment or prevention of a cancer, tumor, growth abnormality, immune disorder, and/or microbial infection. Among certain embodiments of the present invention is the use of a cell-targeting molecule of the present invention and/or pharmaceutical composition thereof in the manufacture of a medicament for the treatment or prevention of a cancer, tumor, growth abnormality, immune disorder, or microbial infection.

Among certain embodiments of the present invention is a composition comprising a cell-targeting molecule of the present invention for the delivery of one or more additional exogenous materials into a cell physically coupled with an extracellular target biomolecule of the binding region of the cell-targeting molecule of the present invention. Certain embodiments of the cell-targeting molecules of the present invention may be used to deliver one or more additional exogenous materials into a cell physically coupled with an extracellular target biomolecule of the binding region of the cell-targeting molecule of the present invention. Additionally, the present invention provides a method for delivering exogenous material to the inside of a cell(s) comprising contacting the cell(s), either in vitro or in vivo, with a cell-targeting molecule, pharmaceutical composition, and/or diagnostic composition of the present invention. The present invention further provides a method for delivering exogenous material to the inside of a cell(s) in a patient in need thereof, the method comprising the step of administering to the patient a cell-targeting molecule of the present invention, wherein the target cell(s) is physically coupled with an extracellular target biomolecule of the binding region of the cell-targeting molecule of the present invention.

The use of any composition of the present invention (e.g. a cell-targeting molecule, a pharmaceutical composition, or diagnostic composition) for the diagnosis, prognosis, and/or characterization of a disease, disorder, and/or condition is within the scope of the present invention.

Among certain embodiments of the present invention is the method of detecting a cell using a cell-targeting molecule and/or diagnostic composition of the invention comprising the steps of contacting a cell with said cell-targeting molecule and/or diagnostic composition and detecting the presence of said cell-targeting molecule and/or diagnostic composition. For certain embodiments, the step of contacting the cell(s) occurs in vitro. For certain embodiments, the step of contacting the cell(s) occurs in vivo. For certain embodiments, the step of detecting the cell(s) occurs in vitro. For certain embodiments, the step of detecting the cell(s) occurs in vivo.

For example, a diagnostic composition of the invention may be used to detect a cell in vivo by administering to a chordate subject a composition comprising cell-targeting molecule of the present invention which comprises a detection promoting agent and then detecting the presence of the cell-targeting molecule of the present invention and/or the heterologous, CD8+ T-cell epitope-peptide cargo either in vitro or in vivo.

Certain embodiments of the cell-targeting molecules of the present invention may be utilized for the delivery of additional exogenous material into a cell physically coupled with an extracellular target biomolecule of the cell-targeting molecule of the invention. Additionally, the present invention provides a method for delivering exogenous material to the inside of a cell(s) comprising contacting the cell(s), either in vitro or in vivo, with a cell-targeting molecule, pharmaceutical composition, and/or diagnostic composition of the present invention. The present invention further provides a method for delivering exogenous material to the inside of a cell(s) in a patient, the method comprising the step of administering to the patient a cell-targeting molecule of the present invention (with or without cytotoxic activity), wherein the target cell(s) is physically coupled with an extracellular target biomolecule of the cell-targeting molecule.

Among certain embodiments of the present invention is a method of delivering into a cell a T-cell epitope-peptide cargo capable of being presented by a MHC class I molecule of the cell, the method comprising the step of contacting the cell with the cell-targeting molecule of the present invention which is associated with a heterologous, T-cell epitope-peptide cargo and/or a composition thereof (e.g., a pharmaceutical or diagnostic composition of the present invention).

Among certain embodiments of the present invention is a method for "seeding" a tissue locus within a chordate, the method comprising the step of: administering to the chordate a cell-targeting molecule of the present invention, a pharmaceutical composition of the present invention, and/or a diagnostic composition of the present invention. In certain further embodiments, the methods of the invention for "seeding" a tissue locus are for "seeding" a tissue locus which comprises a malignant, diseased, or inflamed tissue. In certain further embodiments, the methods of the invention for "seeding" a tissue locus are for "seeding" a tissue locus which comprises the tissue selected from the group consisting of: diseased tissue, tumor mass, cancerous growth, tumor, infected tissue, or abnormal cellular mass. In certain further embodiments, the methods of the invention for "seeding" a tissue locus comprises administering to the chordate the cell-targeting molecule of the invention, the pharmaceutical composition of the invention, or the diagnostic composition of the invention comprising the heterologous, T-cell epitope-peptide cargo selected from the group consisting of: peptides not natively presented by the target cells of the cell-targeting molecule in MHC class I complexes, peptides not natively present within any protein expressed by the target cell, peptides not natively present within the proteome of the target cell, peptides not natively present in the extracellular microenvironment of the site to be seeded, and peptides not natively present in the tumor mass or infected tissue site to be targeted.

The use of any composition of matter of the present invention for the diagnosis, prognosis, and/or characterization of a disease, disorder, and/or condition is within the scope of the present invention. Among certain embodiments of the present invention is a method of using a cell-targeting molecule of the present invention comprising a detection promoting agent and/or composition of the invention (e.g. a diagnostic composition) for the collection of information useful in the diagnosis, prognosis, or characterization of a disease, disorder, or condition. Among certain embodiments of the present invention is the method of detecting a cell (or subcellular compartment thereof) using a cell-targeting molecule and/or diagnostic composition of the present invention, the method comprising the steps of contacting a cell with the cell-targeting molecule and/or diagnostic composition and detecting the presence of said cell-targeting molecule and/or diagnostic composition. In certain embodiments, the step of contacting the cell(s) occurs in vitro. In certain embodiments, the step of contacting the cell(s) occurs in vivo. In certain embodiments, the step of detecting the cell(s) occurs in vitro. In certain embodiments, the step of detecting the cell(s) occurs in vivo. In certain further embodiments, the method involves the detection of the location of the cell-targeting molecule in an organism using one or more imaging procedures after the administration of the cell-targeting molecule to said organism. For example, cell-targeting molecules of the invention which incorporate detection promoting agents as described herein may be used to characterize diseases as potentially treatable by a related pharmaceutical composition of the present invention. For example, certain cell-targeting molecules of the present invention and compositions thereof (e.g. pharmaceutical compositions and diagnostic compositions of the present invention), and methods of the present invention may be used to determine if a patient belongs to a group that responds to a pharmaceutical composition of the present invention.

For example, certain cell-targeting molecules of the present invention and compositions thereof may be used to identify cells which present a delivered heterologous epitope-peptide cargo on a cellular surface and/or to identify subjects containing cells which present a heterologous epitope-peptide cargo delivered by a cell-targeting molecule of the present invention.

Among certain embodiments of the present invention is a method of producing a molecule of the present invention, the method comprising the step of purifying the molecule of the invention or a polypeptide component of thereof using a bacterial cell-wall protein domain interaction, such as, e.g., protein L from *P. magnus* or derivatives and binding domain fragments thereof. In certain further embodiments, the purifying step of the method involves the Shiga toxin effector polypeptide comprising or consisting essentially of any one of the polypeptides shown in SEQ ID NOs: 29-38.

Among certain embodiments of the present invention are kits comprising a composition of matter of the invention, and optionally, instructions for use, additional reagent(s), and/or pharmaceutical delivery device(s). The kit may further comprise reagents and other tools for detecting a cell type (e.g. a tumor cell) in a sample or in a subject.

These and other features, aspects and advantages of the present invention will become better understood with regard to the following description, appended claims, and accompanying figures. The aforementioned elements of the invention may be individually combined or removed freely in order to make other embodiments of the invention, without any statement to object to such combination or removal hereinafter.

BRIEF DESCRIPTION OF THE FIGURES

FIG. 1A and FIG. 1B depict exemplary, cell-targeting molecules comprising a heterologous, CD8+ T-cell epitope-peptide cargo (shown as a diamond shape). These exemplary cell-targeting molecules each comprise a Shiga toxin effector polypeptide having a combination of features: de-immunizing mutations (shown as a horizontally striped region), an embedded, heterologous, CD8+ T-cell epitope (shown as a vertically striped region), and sometimes a disrupted or missing protease site (shown with a dashed line). The "N" and "C" denote an amino-terminus and carboxy-terminus, respectively, of a polypeptide component of a cell-targeting molecule. These exemplary cell-targeting molecules sometimes comprise a Shiga toxin effector polypeptide having the third feature of a disrupted furin-cleavage site at the carboxy-terminus of an A1 fragment derived region depicted with a dashed, vertical, gray line.

The depictions of exemplary molecules in FIG. 1A and FIG. 1B are for illustrative purposes of certain, general arrangements of the structural features of a limited set of embodiments of the present invention. It is to be understood that these exemplary molecules do not intend, nor should any be construed, to be wholly definitive as to the arrangement of any structural features and/or components of a molecule of the present invention. The relative size, location, or number of features shown in the schematics of FIG. 1A and FIG. 1B have been simplified. For example, the relative positions of embedded, heterologous epitopes and disruptions of an endogenous, epitope regions are not fixed. Similarly, the total numbers of embedded, heterologous epitopes and disruptions of an endogenous, epitope regions are not fixed. Certain embodiments of the molecules of the present invention comprise a plurality of disrupted, endogenous, epitope regions in a single, Shiga toxin effector polypeptide, such as, e.g., disruptions of four, five, six, seven, eight, nine, or more regions; wherein these disrupted, endogenous, epitope regions may be distributed throughout the Shiga toxin effector polypeptide, including disruptions which overlap with or are within the furin-cleavage motif of the carboxy-terminus region of a Shiga toxin A1 fragment derived region (see e.g. WO 2016/196344). Certain embodiments of the present invention comprise disruptions of endogenous, epitope regions which are carboxy-terminal to the carboxy-terminus of the Shiga toxin A1 fragment, or a derivative thereof, such as, e.g. at a position carboxy-terminal to any disrupted furin-cleavage site motif. The schematics in FIG. 1A and FIG. 1B are not intended to accurately portray any information regarding the relative sizes of molecular structures in any embodiment of the present invention.

FIG. 2 graphically shows that the exemplary cell-targeting molecule SLT-1A-DI-FR::scFv1::C2 (SEQ ID NO:252) exhibited cytotoxicity to two, different cell-types comparable to a "control" cell-targeting molecule SLT-1A-DI-FR::scFv-1 (SEQ ID NO:258). The percent viability of target positive cells for each cell type was plotted over the logarithm to base 10 of the cell-targeting molecule concentration administered to the respective cells.

FIG. 3 graphically shows cell-surface presentation of a cell-targeting molecule delivered, heterologous, CD8+ T-cell epitope-peptide complexed with MHC class I molecule by a target positive cancer cell as compared to a negative control. FIG. 3 shows overlays of the results of a TCR-STAR™ assay, flow cytometric analysis of sets of cells treated either with the exemplary cell-targeting molecule of the present invention SLT-1A-DI-FR::scFv1::C2 (SEQ ID NO:252) or a negative control, the cell-targeting molecule SLT-1A-DI-FR::scFv1 (SEQ ID NO:258), which lacks any C2 epitope-peptide cargo. The FACS cell count of target positive cells was plotted over the light signal from PE-STAR™ multimer reagent in relative light units (RLU) representing the presence of cell-surface, MHC class I molecule (human HLA-A2) displayed C2 epitope-peptide (SEQ ID NO:21) complexes. Target positive cells treated with the exemplary cell-targeting molecule of the present invention SLT-1A-DI-FR::scFv1::C2 (SEQ ID NO:252) displayed the C2 epitope-peptide (SEQ ID NO:21) complexed to MHC class I molecules on their cell surfaces (upper graph), whereas target positive cells treated with the parental cell-targeting molecule SLT-1A-DI-FR::scFv1 (SEQ ID NO:258) did not display the C2 epitope-peptide (SEQ ID NO:21) on a cell surface (lower graph).

FIG. 4 graphically shows the sizes and proportions of molecules present in a sample preparation of SLT-1A-DI-FR::scFv1::C2 (SEQ ID NO:252) analyzed by size exclusion chromatography (SEC). For the SEC analysis, the absorbance of ultraviolet light at a wavelength of 280 nanometers (nm) of the material eluted after flowing through a SEC column was plotted in milli-absorbance units (mAU) over the fraction volume in milliliters (mL). Software was used to identify individual peaks in the 280 nm trace and the fraction volume of each peak's maximum absorbance of ultraviolet light at 280 nm.

FIG. 5 shows a Coomassie-stained, sodium dodecyl sulfate, polyacrylamide gel (SDS-PAGE) after electrophoresis of sample preparation of SLT-1A-DI-FR::scFv1::C2 (SEQ ID NO:252) prepared for gel-loading under reducing conditions. FIG. 5 shows that size of reduced SLT-1A-DI-FR::scFv1::C2 (SEQ ID NO:252) was about 55 kiloDaltons (kDa).

FIG. 6 graphically shows fusing a heterologous, CD8+ T-cell epitope-peptide to a Shiga toxin A Subunit derived, cell-targeting molecule did not significantly impair the cytotoxic activity of the cell-targeting molecule toward target positive cells. The percent viability of cells was plotted over the logarithm to base 10 of the protein concentration. FIG. 6 graphically shows the results of a cell-kill assay where SLT-1A::scFv1::C2 (SEQ ID NO:278) exhibited cytotoxicity similar to the cytotoxicity of the parental cell-targeting molecule SLT-1A::scFv1 (SEQ ID NO:280), which lacked any heterologous, CD8+ T-cell epitope-peptide.

FIG. 7 graphically shows the results of a cell-kill assay where the cytotoxic activity of the exemplary cell-targeting molecule SLT-1A::scFv1::C2 (SEQ ID NO:278) was specific to target positive cells over a certain concentration range. The percent viability of cells was plotted over the logarithm to base 10 of the protein concentration. Cells negative for cell-surface expression of a target biomolecule of the binding region scFv2 were not killed (approximately 100% cell viability) by SLT-1A::scFv1::C2 (SEQ ID NO:278) over the molecule concentration range used to accurately measure the $CD_{50}$ value of SLT-1A::scFv1::C2 (SEQ ID NO:278) toward target positive cells and as shown in FIG. 6.

FIG. 8 graphically shows cell-surface presentation of a cell-targeting molecule delivered, heterologous, CD8+ T-cell epitope-peptide complexed with MHC class I molecule by a target positive cancer cell as compared to a negative control. FIG. 8 shows overlays of the results of a TCR-STAR™ assay, flow cytometric analysis of sets of cells treated either with a negative control, the cell-targeting molecule SLT-1A::scFv1::C2 (SEQ ID NO:278), or the cell-targeting molecule SLT-1A::scFv2 (SEQ ID NO:281). The fluorescence-activated cell sorting (FACS) flow cytometry cell count of target positive cells was plotted over the light signal from PE-STAR™ multimer reagent in relative light units (RLU) representing the presence of cell-surface, MHC class I molecule (human HLA-A2) displayed C2 epitope-peptide (SEQ ID NO:21) complexes. Target positive cells treated with the exemplary cell-targeting molecule of the present invention SLT-1A::scFv1::C2 (SEQ ID NO:278) displayed the C2 epitope-peptide (SEQ ID NO:21) complexed to MHC class I molecules on their cell surfaces (upper graph), whereas target positive cells treated with the related cell-targeting molecule SLT-1A::scFv2 (SEQ ID NO:281) did not display the C2 epitope-peptide (SEQ ID NO:21) on a cell surface (lower graph).

FIG. 9 graphically shows cell-surface presentation of a cell-targeting molecule delivered, heterologous, CD8+ T-cell epitope-peptide complexed with MHC class I molecule by a target positive cancer cell as compared to negative controls. In FIG. 9, the indexed, mean, fluorescent intensity ("iMFI," the fluorescence of the positive population multiplied by the percent positive) of the PE-STAR™ multimer reagent in RLU corresponding to the sets of cells receiving the different treatments was graphed. FIG. 9 shows the results of a TCR-STAR Assay™, flow cytometric analysis of cells treated with either an exogenous C2 peptide (SEQ ID NO:21) control, "inactive SLT-1A::scFv" (SEQ ID NO:282), or the cell-targeting molecule "inactive SLT-1A::scFv2::C2" (SEQ ID NO:270). Exogenously administered C2 peptide ((SEQ ID NO:21), as above) combined with a Peptide Loading Enhancer ("PLE," Altor Bioscience Corp., Miramar, Fla., U.S.). The C2 peptide (SEQ ID NO:21) combined with Peptide Loading Enhancer (PLE) treatment provides a positive control where exogenously administered C2 peptide (SEQ ID NO:21) may be loaded onto cell-surface MHC class I molecules without ever entering a cell. Target positive cells treated with the exemplary cell-targeting molecule of the present invention "inactive SLT-1A::scFv2::C2" (SEQ ID NO:270) displayed the C2 epitope-peptide (SEQ ID NO:21) complexed to MHC class I molecules on their cell surfaces, whereas the same cells treated with only exogenous C2 epitope-peptide (SEQ ID NO:21) or the parental cell-targeting molecule "inactive SLT-1A::scFv2" (SEQ ID NO:282) did not display the C2 epitope-peptide (SEQ ID NO:21) on a cell surface.

FIG. 10 graphically shows cell-surface presentation of a cell-targeting molecule delivered, heterologous, CD8+ T-cell epitope-peptide complexed with MHC class I molecule by a target positive cancer cell for different incubation times (4 hours or 16 hours) as compared to a negative control. FIG. 10 shows overlays of the results of a TCR-STAR™ assay, flow cytometric analysis of sets of cells treated either with the cell-targeting molecule SLT-1A::scFv1::C2 (SEQ ID NO:278) or a negative control. The FACS cell count of target positive cells was plotted over the light signal from PE-STAR™ multimer reagent in relative light units (RLU) representing the presence of cell-surface, MHC class I molecule (human HLA-A2) displayed C2 epitope-peptide (SEQ ID NO:21) complexes. Target positive cells treated with the exemplary cell-targeting molecule of the present invention SLT-1A::scFv1::C2 (SEQ ID NO:278) displayed the C2 epitope-peptide (SEQ ID NO:21) complexed to MHC class I molecules on their cell surfaces after either a 4-hour (4 hrs) (upper graph) or 16-hour (16 hrs) (lower graph) incubation duration.

FIG. 11 graphically shows cell-surface presentation of a cell-targeting molecule delivered, heterologous, CD8+ T-cell epitope-peptide complexed with MHC class I molecule by a target positive cancer cell as compared to a negative control. FIG. 11 shows overlays of the results of a TCR-STAR™ assay, flow cytometric analysis of sets of cells treated either with a negative control, the cell-targeting molecule SLT-1A::scFv5::C2 (SEQ ID NO:274), or the cell-targeting molecule SLT-1A::scFv5 (SEQ ID NO:283). The FACS cell count of target positive cells was plotted over the light signal from PE-STAR™ multimer reagent in relative light units (RLU) representing the presence of cell-surface, MHC class I molecule (human HLA-A2) displayed C2 epitope-peptide (SEQ ID N0:21) complexes. Target positive cells treated with the exemplary cell-targeting molecule of the present invention SLT-1A::scFv5::C2 (SEQ ID NO:274) displayed the C2 epitope-peptide (SEQ ID NO:21) complexed to MHC class I molecules on their cell surfaces (upper graph), whereas target positive cells treated with the parental cell-targeting molecule SLT-1A::scFv5 (SEQ ID NO:283) did not display the C2 epitope-peptide (SEQ ID NO:21) on a cell surface (lower graph).

FIG. 12 graphically shows cell-surface presentation of a cell-targeting molecule delivered, heterologous, CD8+ T-cell epitope-peptide complexed with MHC class I molecule by a target positive cancer cell as compared to a negative control. FIG. 12 shows overlays of the results of a TCR-STAR™ assay, flow cytometric analysis of sets of cells treated either with a negative control, the cell-targeting molecule SLT-1A::scFv7::C2 (SEQ ID NO:277), or the cell-targeting molecule SLT-1A::scFv7 (SEQ ID NO:286). The FACS cell count of target positive cells was plotted over the light signal from PE-STAR™ multimer reagent in relative light units (RLU) representing the presence of cell-surface, MHC class I molecule (human HLA-A2) displayed C2 epitope-peptide (SEQ ID NO:21) complexes. Target positive cells treated with the exemplary cell-targeting molecule of the present invention SLT-1A::scFv7::C2 (SEQ ID NO:277) displayed the C2 epitope-peptide (SEQ ID NO:21) complexed to MHC class I molecules on their cell surfaces (upper graph), whereas target positive cells treated with the parental cell-targeting molecule SLT-1A::scFv7 (SEQ ID NO:286) did not display the C2 epitope-peptide (SEQ ID NO:21) on a cell surface (lower graph).

FIG. 13 graphically shows the results from an Interferon Gamma ELIspot assay with the number of spots, or secreting cells, plotted for each condition tested. For each sample, target positive human cancer cells were pretreated with a cell-targeting molecule or negative control and, then, incubated with human PBMCs (HLA-A2 serotype) for 24 hours before performing the ELISPOT assay. FIG. 13 shows that target positive cells treated with the exemplary cell-targeting molecule of the present invention "inactive SLT-1A::scFv2::C2" (SEQ ID NO:270) promoted cytokine secretion by PBMCs, whereas treatment with the parental cell-targeting molecule "inactive SLT-1A::scFv2" (SEQ ID NO:282) resulted only in a background level of interferon-γ secretion at about the same level as the negative control treatment of "buffer only." The notation "Target positive Cell Line G+PBMCs" indicates that all the samples shown involved a coculture of tumor cells of cell line G with PBMCs.

FIG. 14 graphically shows the results from an intercellular T lymphocyte (T-cell) activation assay with luciferase activity plotted in RLU for each condition tested. For each sample, target positive human cancer cells were pretreated with a cell-targeting molecule or negative control and, then, incubated for 18 hours with human J76 T-cells expressing a human T-cell receptor (TCR) that specifically recognizes cell-surface presented, human MHC class I molecule (HLA-A2) F2 epitope (SEQ ID NO:25) complexes, and comprising a nuclear factor of activated T-cells (NFAT) transcriptional response element driving luciferase expression (luciferase-reporter-transfected). Luciferase activity in the samples, indicating NFAT activity in the T-cells, was measured using the One-Glo™ Luciferase Assay System reagent according the manufacturer's instructions. FIG. 14 shows that target positive tumor cells pretreated with the exemplary cell-targeting molecule of the present invention “inactive SLT-1A::scFv6::F2” (SEQ ID NO:276) stimulated an intermolecular response in the form of T-cell activation via TCR recognition and NFAT signaling; whereas, treatment of target positive cells with the parental cell-targeting molecule “inactive SLT-1A::scFv6” (SEQ ID NO:285) resulted only in the background level of light signal at about the same level as the negative control treatment of “buffer only.” The notation “Target positive Cell Line F+Reporter T cells” indicates that all the samples shown involved a coculture of tumor cells of cell line G with the luciferase-reporter transfected J76 T-cells (HLA-A2 serotype) as described above.

FIG. 15 graphically shows the results from an IFN-γ ELISA assay with data from the “buffer only” sample in black and from the cell-targeting molecule treated sample in grey. Along the Y-axis is the quantification of IFN-γ present in the supernatants from a coculture experiment reported in picograms per mL (pg/mL). The cells of the coculture consisted of human PBMCs enriched for C2-restricted PBMCs and human tumor cells. The tumor cells used were of the cell line I and were pretreated with “inactive SLT-1A-DI-4::scFv6::(C2)3” (SEQ ID NO:253). FIG. 15 shows that coculture of PBMCs with target positive tumor cells after incubation with the cell targeting molecule “inactive SLT-1A-DI-4::scFv6::(C2)3” (SEQ ID NO:253) but not with “buffer only” results in the induction of human IFN-γ secretion indicative of activated T-cells among the PBMCs.

FIG. 16 graphically shows the results from a CellTiter-Glo® Luminescent Cell Viability assay of a coculture experiment with data from the “buffer only” sample in black and from the cell-targeting molecule treated sample in grey. Along the Y-axis is the quantification of adherent-cell viability expressed as a percentage of the “buffer only” negative control in RLU. The cells of the coculture consisted of human PBMCs enriched for C2-restricted PBMCs and human tumor cells. The tumor cells used were of the cell line I and were pretreated with “inactive SLT-1A-DI-4::scFv6::(C2)3” (SEQ ID NO:253). FIG. 16 shows that coculture PBMCs with target positive tumor cells after incubation with the cell targeting molecule “inactive SLT-1A-DI-4::scFv6::(C2)3” (SEQ ID NO:253) but not with “buffer only” results in tumor cell-killing as demonstrated by the large reduction in the viability percentage of the adherent tumor cells.

FIG. 17 graphically plots the number of immune cells clustered during different time-points of a 140-hour coculture experiment with data from the “buffer only” sample in black and from the cell-targeting molecule treated sample in grey. The cells were counted using the IncuCyte® S3 Live-Cell imaging assay performed as described herein. The cells of the coculture consisted of human PBMCs enriched for C2-restricted PBMCs and human tumor cells. The tumor cells used were of the cell line I and were pretreated with “inactive SLT-1A-DI-4::scFv6::(C2)3” (SEQ ID NO:253). The quantity cells involved and the quantity of PBMC clusters of over 100 microns are indicative of immune cell activation occurring in the coculture. The quantities of cells and clusters over time (the persistency of immune cell clustering behavior) is also indicative immune cell activation occurring in the coculture.

FIG. 18 graphically shows the results from IFN-γ ELISA assays with data from three-different tumor cell types treated with three different concentrations of an exemplary cell-targeting molecule of the present invention (SEQ ID NO:254) (shown in grey) and data from a control treatment using a cell-targeting molecule lacking any C2 epitope-peptide cargo for delivery (SEQ ID NO:256) (shown in black). Along the Y-axis is the quantification of IFN-γ present in the supernatants from coculture experiments reported in pg/mL. The x-axis shows four different experimental conditions: no PBMC-coculture, “buffer only” treatment of tumor cells before coculture, treatment of tumor cells with 100 nM of molecule, and treatment with tumor cells with 500 nM of molecule. The cells of the coculture consisted of human PBMCs enriched for C2-restricted PBMCs and human tumor cells. The tumor cells used were of the cell line I, J, or K and were pretreated with either “inactive SLT-1A-DI-1::scFv8::C2” (SEQ ID NO:254) or “inactive SLT-1A-DI-1::scFv8” (SEQ ID NO:256). As the concentration of exemplary cell-targeting molecule of the present invention in the treatment goes up from zero to 100, and 500 nM, the quantity of secreted human IFN-γ in the coculture goes up (e.g., to above about 400 or 600 pg/mL). The results show that neither “buffer only” or the closely related reference cell-targeting molecule “inactive SLT-1A-DI-1::scFv8” (SEQ ID NO:256) lacking the of C2 epitope-peptide (SEQ ID NO:21) was capable of inducing IFN-γ secretion after 48 hours post-coculture. The notation “+PBMCs” indicates the sample shown involved a coculture of tumor cells and PBMCs.

FIG. 19 graphically shows the results from CellTiter-Glo® Luminescent Cell Viability assays of coculture experiments with data from three-different tumor cell types treated with three different concentrations of an exemplary cell-targeting molecule of the present invention (SEQ ID NO:254) (shown in grey) and data from a control treatment using a cell-targeting molecule lacking any C2 epitope-peptide cargo for delivery (SEQ ID NO:256) (shown in black). Along the Y-axis is the quantification of adherent-cell viability in RLU. The x-axis shows four different experimental conditions: no PBMC-coculture, “buffer only” treatment of tumor cells before coculture, treatment of tumor cells with 100 nM of molecule, and treatment with tumor cells with 500 nM of molecule. The cells of the coculture consisted of human PBMCs enriched for C2-restricted PBMCs and human tumor cells. The tumor cells used were of the cell line I, J, or K and were pretreated with either “inactive SLT-1A-DI-1::scFv8::C2” (SEQ ID NO:254) or “inactive SLT-1A-DI-1::scFv8” (SEQ ID NO:256). As the concentration of the exemplary cell-targeting molecule of the present invention “inactive SLT-1A-DI-1::scFv8::C2” (SEQ ID NO:254) in the treatment goes up from zero to 100, and 500 nM, the adherent cell viability drops to below 50 percent. The results show that neither “buffer only” or the closely related reference cell-targeting molecule “inactive SLT-1A-DI-FR::scFv8” (SEQ ID NO:256) lacking the of C2 epitope-peptide (SEQ ID NO:21) was capable of causing significant target cell death during 96 hours of coculture. The notation “+PBMCs” indicates the sample shown involved a coculture of tumor cells and PBMCs.

FIG. 20 graphically shows the results from IFN-γ ELISA and CellTiter-Glo® Luminescent Cell Viability assays of coculture experiments with pretreatment of tumor cells with an exemplary cell-targeting molecule of the present invention (SEQ ID NO:255) shown in grey and data from the control treatment using a catalytically-active cell-targeting molecule lacking any C2 epitope-peptide cargo for delivery shown in black (SEQ ID NO:257). The cells of the coculture consisted of human PBMCs enriched for C2-restricted PBMCs and human tumor cells. The tumor cells used were of the cell line I and were pretreated with the catalytically-active SLT-1A-DI-1::scFv8::C2 (SEQ ID NO:255) or with the catalytically active control molecule SLT-1A-DI-1::

scFv8 (SEQ ID NO:257). For the graph on the left side, the Y-axis shows the quantification of IFN-γ present in the supernatants from the coculture experiments reported in pg/mL. For the graph on the right side, the Y-axis shows the quantification of adherent-cell viability in RLU. For both graphs, the x-axis shows four different experimental conditions: no PBMC-coculture, "buffer only" treatment of tumor cells before coculture, treatment of tumor cells with 30 nM of molecule, and treatment of tumor cells with 100 nM of molecule. As the concentration of the exemplary cell-targeting molecule of the present invention SLT-1A-DI-1::scFv8::C2 (SEQ ID NO:255) in the treatment goes up from zero to 30 and 100 nM, the quantity of secreted human IFN-γ in the coculture goes up to above 200 pg/mL and the adherent cell viability is reduced more than treatment with a closely related, catalytically-active cell-targeting molecule SLT-1A-DI-1::scFv8 (SEQ ID NO:257) lacking any C2 epitope-peptide (SEQ ID NO:21) cargo. The control molecule did not induce any human IFN-γ secretion by the PBMCs in coculture and did not reduce tumor cell viability over time as much as the exemplary molecule of the present invention did for a given molecule treatment concentration. The notation "+PBMCs" indicates the sample shown involved a coculture of tumor cells and PBMCs.

DETAILED DESCRIPTION

The present invention is described more fully hereinafter using illustrative, non-limiting embodiments, and references to the accompanying figures. This invention may, however, be embodied in many different forms and should not be construed as to be limited to the embodiments set forth below. Rather, these embodiments are provided so that this disclosure is thorough and conveys the scope of the invention to those skilled in the art. In order that the present invention may be more readily understood, certain terms are defined below. Additional definitions may be found within the detailed description of the invention.

As used in the specification and the appended claims, the terms "a," "an" and "the" include both singular and the plural referents unless the context clearly dictates otherwise.

As used in the specification and the appended claims, the term "and/or" when referring to two species, A and B, means at least one of A and B. As used in the specification and the appended claims, the term "and/or" when referring to greater than two species, such as A, B, and C, means at least one of A, B, or C, or at least one of any combination of A, B, or C (with each species in singular or multiple possibility).

Throughout this specification, the word "comprise" or variations such as "comprises" or "comprising" will be understood to imply the inclusion of a stated integer (or components) or group of integers (or components), but not the exclusion of any other integer (or components) or group of integers (or components).

Throughout this specification, the term "including" is used to mean "including but not limited to." "Including" and "including but not limited to" are used interchangeably.

The term "amino acid residue" or "amino acid" includes reference to an amino acid that is incorporated into a protein, polypeptide, and/or peptide. The term "polypeptide" includes any polymer of amino acids or amino acid residues. The term "polypeptide sequence" refers to a series of amino acids or amino acid residues which physically comprise a polypeptide. A "protein" is a macromolecule comprising one or more polypeptides or polypeptide "chains." A "peptide" is a small polypeptide of sizes less than about a total of 15 to 20 amino acid residues. The term "amino acid sequence" refers to a series of amino acids or amino acid residues which physically comprise a peptide or polypeptide depending on the length. Unless otherwise indicated, polypeptide and protein sequences disclosed herein are written from left to right representing their order from an amino terminus to a carboxy terminus.

The terms "amino acid," "amino acid residue," "amino acid sequence," or polypeptide sequence include naturally occurring amino acids (including L and D isosteriomers) and, unless otherwise limited, also include known analogs of natural amino acids that can function in a similar manner as the common natural amino acids, such as selenocysteine, pyrrolysine, N-formylmethionine, gamma-carboxyglutamate, hydroxyprolinehypusine, pyroglutamic acid, and selenomethionine (see e.g. Young T, Schultz P, *J Biol Chem* 285: 11039-44 (2010); Davis L, Chin J, *Nat Rev Mol Cell Biol* 13: 168-82 (2012); Bohike N, Budisa N, *FEMS Microbiol Lett* 35: 133-44 (2014); Chin J, *Annu Rev Biochem* 83: 379-408 (2014); Nagata K et al., *Bioinformatics* 30: 1681-9 (2014); Pott M et al., *ACS Chem Biol* 9: 2815-22 (2014); Ho J et al., *ACS Synth Biol* 5: 163-71 (2016); Wang Y, Tsao M, *Chembiochem* 17: 2234-9 (2016)). The amino acids referred to herein are described by shorthand designations as follows in Table A:

TABLE A

| Amino Acid Nomenclature | | |
|---|---|---|
| Name | 3-letter | 1-letter |
| Alanine | Ala | A |
| Arginine | Arg | R |
| Asparagine | Asn | N |
| Aspartic Acid or Aspartate | Asp | D |
| Cysteine | Cys | C |
| Glutamic Acid or Glutamate | Glu | E |
| Glutamine | Gln | Q |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

The phrase "conservative substitution" with regard to an amino acid residue of a peptide, peptide region, polypeptide region, protein, or molecule refers to a change in the amino acid composition of the peptide, peptide region, polypeptide region, protein, or molecule that does not substantially alter the function and structure of the overall peptide, peptide region, polypeptide region, protein, or molecule (see Creighton, *Proteins: Structures and Molecular Properties* (W. H. Freeman and Company, New York (2nd ed., 1992))).

For purposes of the present invention, the phrase "derived from" when referring to a polypeptide or polypeptide region means that the polypeptide or polypeptide region comprises highly similar amino acid sequences originally found in a "parental" protein and which may now comprise certain amino acid residue additions, deletions, truncations, rearrangements, or other alterations relative to the original polypeptide or polypeptide region as long as a certain function(s) and a structure(s) of the "parental" molecule are substantially conserved. The skilled worker will be able to identify a parental molecule from which a polypeptide or polypeptide region was derived using techniques known in the art, e.g., protein sequence alignment software.

For purposes of the present invention, the terms "terminus," "amino terminus," or "carboxy terminus" with regard to a polypeptide region refers to the regional boundaries of that region, regardless of whether additional amino acid residues are linked by peptide bonds outside of that region. In other words, the terminals of the polypeptide region regardless of whether that region is fused to other peptides or polypeptides. For example, a fusion protein comprising two proteinaceous regions, e.g., a binding region comprising a peptide or polypeptide and a Shiga toxin effector polypeptide, may have a Shiga toxin effector polypeptide region with a carboxy terminus ending at amino acid residue 251 of the Shiga toxin effector polypeptide region despite a peptide bond involving residue 251 to an amino acid residue at position 252 representing the beginning of another proteinaceous region, e.g., the binding region. In this example, the carboxy terminus of the Shiga toxin effector polypeptide region refers to residue 251, which is not a terminus of the fusion protein but rather represents an internal, regional boundary. Thus, for polypeptide regions, the terms "terminus," "amino terminus," and "carboxy terminus" are used to refer to the boundaries of polypeptide regions, whether the boundary is a physically terminus or an internal, position embedded within a larger, continuous polypeptide chain.

For purposes of the claimed invention and with regard to a Shiga toxin polypeptide sequence or Shiga toxin derived polypeptide, the term "wild-type" generally refers to a naturally occurring, Shiga toxin protein sequence(s) found in a living species, such as, e.g., a pathogenic bacterium, wherein that Shiga toxin protein sequence(s) is one of the most frequently occurring variants. This is in contrast to infrequently occurring Shiga toxin protein sequences that, while still naturally occurring, are found in less than one percent of individual organisms of a given species when sampling a statistically powerful number of naturally occurring individual organisms of that species which comprise at least one Shiga toxin protein variant. A clonal expansion of a natural isolate outside its natural environment (regardless of whether the isolate is an organism or molecule comprising biological sequence information) does not alter the naturally occurring requirement as long as the clonal expansion does not introduce new sequence variety not present in naturally occurring populations of that species and/or does not change the relative proportions of sequence variants to each other.

The terms "associated," "associating," "linked," or "linking" with regard to the claimed invention refers to the state of two or more components of a molecule being joined, attached, connected, or otherwise coupled to form a single molecule or the act of making two molecules associated with each other to form a single molecule by creating an association, linkage, attachment, and/or any other connection between the two molecules. For example, the term "linked" may refer to two or more components associated by one or more atomic interactions such that a single molecule is formed and wherein the atomic interactions may be covalent and/or non-covalent. Non-limiting examples of covalent associations between two components include peptide bonds and cysteine-cysteine disulfide bonds. Non-limiting examples of non-covalent associations between two molecular components include ionic bonds.

For purposes of the present invention, the term "linked" refer to two or more molecular components associated by one or more atomic interactions such that a single molecule is formed and wherein the atomic interactions include at least one covalent bond. For purposes of the present invention, the term "linking" refers to the act of creating a linked molecule as described above.

For purposes of the present invention, the term "fused" refers to two or more proteinaceous components associated by at least one covalent bond which is a peptide bond, regardless of whether the peptide bond involves the participation of a carbon atom of a carboxyl acid group or involves another carbon atom, such as, e.g., the α-carbon, β-carbon, γ-carbon, σ-carbon, etc. Non-limiting examples of two proteinaceous components fused together include, e.g., an amino acid, peptide, or polypeptide fused to a polypeptide via a peptide bond such that the resulting molecule is a single, continuous polypeptide. For purposes of the present invention, the term "fusing" refers to the act of creating a fused molecule as described above, such as, e.g., a fusion protein generated from the recombinant fusion of genetic regions which when translated produces a single proteinaceous molecule.

The symbol "::" means the polypeptide regions before and after it are physically linked together to form a continuous polypeptide.

Throughout this specification, the term "bispecific" will be understood to include molecules which bind different extracellular target biomolecules or which bind the same extracellular target biomolecule at two or more different epitopes, whether non-overlapping or overlapping epitopes (e.g. a bivalent biparatopic molecule).

As used herein, the terms "expressed," "expressing," or "expresses," and grammatical variants thereof, refer to translation of a polynucleotide or nucleic acid into a protein. The expressed protein may remain intracellular, become a component of the cell surface membrane or be secreted into an extracellular space.

As used herein, cells which express a significant amount of an extracellular target biomolecule at least one cellular surface are "target positive cells" or "target+cells" and are cells physically coupled to the specified, extracellular target biomolecule. A significant amount of target biomolecule is defined below.

As used herein, the symbol "α" is shorthand for an immunoglobulin-type binding region capable of binding to the biomolecule following the symbol. The symbol "α" is used to refer to the functional characteristic of an immunoglobulin-type binding region based on its ability to bind to the biomolecule following the symbol with a binding affinity described by a dissociation constant ($K_D$) of $10^{-5}$ or less.

As used herein, the term "heavy chain variable ($V_H$) domain" or "light chain variable ($V_L$) domain" respectively refer to any antibody $V_H$ or $V_L$ domain (e.g. a human $V_H$ or $V_L$ domain) as well as any derivative thereof retaining at least qualitative antigen binding ability of the corresponding native antibody (e.g. a humanized $V_H$ or $V_L$ domain derived from a native murine $V_H$ or $V_L$ domain). A $V_H$ or $V_L$ domain consists of a "framework" region interrupted by the three CDRs or ABRs. The framework regions serve to align the CDRs or ABRs for specific binding to an epitope of an antigen. From amino terminus to carboxy terminus, both $V_H$ and $V_L$ domains comprise the following framework (FR) and CDR regions or ABR regions: FR1, CDR1, FR2, CDR2, FR3, CDR3, and FR4; or, similarly, FR1, ABR1, FR2, ABR2, FR3, ABR3, and FR4. As used herein, the terms "HCDR1," "HCDR2," or "HCDR3" are used to refer to CDRs 1, 2, or 3, respectively, in a $V_H$ domain, and the terms "LCDR1," "LCDR2," and "LCDR3" are used to refer to CDRs 1, 2, or 3, respectively, in a $V_L$ domain. As used herein, the terms "HABR1," "HABR2," or "HABR3" are used to refer to ABRs 1, 2, or 3, respectively, in a $V_H$ domain, and the terms "LABR1," "LABR2," or "LABR3" are used to refer to CDRs 1, 2, or 3, respectively, in a $V_L$ domain. For camelid $V_H H$ fragments, IgNARs of cartilaginous fish, $V_{NAR}$ fragments, certain single domain antibodies, and derivatives thereof, there is a single, heavy chain variable domain comprising the same basic arrangement: FR1, CDR1, FR2, CDR2, FR3, CDR3, and FR4. As used herein, the terms "HCDR1," "HCDR2," or "HCDR3" may be used to refer to CDRs 1, 2, or 3, respectively, in a single heavy chain variable domain.

For purposes of the present invention, the term "effector" means providing a biological activity, such as cytotoxicity, biological signaling, enzymatic catalysis, subcellular routing, and/or intermolecular binding resulting in an allosteric effect(s) and/or the recruitment of one or more factors. For example, a Shiga toxin effector polypeptide provides one or more biological activities present in a Shiga toxin, Shiga toxin component, and/or fragment thereof.

For purposes of the present invention, the phrases "Shiga toxin effector polypeptide," "Shiga toxin effector polypeptide region," and "Shiga toxin effector region" refer to a polypeptide or polypeptide region derived from at least one Shiga toxin A Subunit of a member of the Shiga toxin family wherein the polypeptide or polypeptide region is capable of exhibiting at least one Shiga toxin function.

For purposes of the present invention, the term "heterologous" as describing a binding region means the binding region is from a different source than a naturally occurring Shiga toxin, e.g. a heterologous binding region which is a polypeptide is polypeptide not naturally found as part of any native Shiga toxin.

For purposes of the present invention, the term "heterologous" as describing a CD8+ T-cell epitope means the CD8+ T-cell epitope is from a different source than (1) an A Subunit of a naturally occurring Shiga toxin, e.g. a heterologous polypeptide is not naturally found as part of any A Subunit of a native Shiga toxin and (2) a prior art Shiga toxin effector polypeptide. For example, in certain embodiments of the cell-targeting molecules of the present invention, the term "heterologous" with regard to a CD8+ T-cell epitope-peptide refers to a peptide sequence which did not initially occur in a cell-targeting molecule to be modified (parental molecule), but which was added to the molecule, whether added via the processes of embedding, fusion, insertion, and/or amino acid substitution as described herein, or by any other engineering means to create a modified cell-targeting molecule. The result is a modified cell-targeting molecule comprising a CD8+ T-cell epitope-peptide which is foreign to the original, unmodified cell-targeting molecule, i.e. the CD8+ T-cell epitope was not present in the unmodified cell-targeting molecule (parental molecule). The 'heterologous' CD8+ T-cell epitope may be autogenous or heterologous with respect to the binding region.

In certain embodiments of the cell-targeting molecule of the present invention, the heterologous, CD8+ T-cell epitope is also heterologous to the binding region component(s) of the cell-targeting molecule, e.g. a heterologous epitope is one that is not required for the binding activity of the binding region and is not part of the structure of the minimum binding region structure which provides the binding activity of the binding region. For example, a CD8+ T-cell epitope not natively present in an immunoglobulin is heterologous to an immunoglobulin-type binding region derived from that immunoglobulin if it is not required for the binding activity of the immunoglobulin-type binding region and is not part of the structure of the minimum binding region structure which provides the binding activity of the immunoglobulin-type binding region.

For purposes of the claimed invention, the term "heterologous" as describing a CD8+ T-cell epitope means of a different source than (1) an A Subunit of a naturally occurring Shiga toxin and (2) the binding region of the cell-targeting molecule comprising the heterologous component. A heterologous, CD8+ T-cell epitope-peptide of the cell-targeting molecule of the present invention is an CD8+ T-cell epitope-peptide not already present in a wild-type Shiga toxin A1 fragment; a naturally occurring Shiga toxin A1 fragment; and/or a prior art Shiga toxin effector polypeptide used as a component of the cell-targeting molecule.

For purposes of the claimed invention, the phrase "intercellular engagement" by a CD8+ immune cell refers to a CD8+ immune cell responding to different cell (for example, by sensing the other is displaying one or more pMHC Is) in fashion indicative of the activation of an immune response by the CD8+ immune cell, such as, e.g., responses involved in killing the other cell, recruiting and activating other immune cells (e.g. cytokine secretion), maturation of the CD8+ immune cell, activation of the CD8+ immune cell, etc.

As used herein, the term "CD8+ T-cell epitope delivering" when describing a functional activity of a molecule means that a molecule provides the biological activity of localizing within a cell to a subcellular compartment that is competent to result in the proteasomal cleavage of a proteinaceous part of the molecule which comprises a CD8+ T-cell epitope-peptide. The "CD8+ T-cell epitope delivering" function of a molecule can be assayed by observing the MHC presentation of a CD8+ T-cell epitope-peptide cargo of the molecule on a cell surface of a cell exogenously administered the molecule or in which the assay was begun with the cell containing the molecule in one or more of its endosomal compartments. Generally, the ability of a molecule to deliver a CD8+ T-cell epitope to a proteasome can be determined where the initial location of the "CD8+ T-cell epitope delivering" molecule is an early endosomal compartment of a cell, and then, the molecule is empirically shown to deliver the epitope-peptide to the proteasome of the cell. However, a "CD8+ T-cell epitope delivering" ability may also be determined where the molecule starts at an extracellular location and is empirically shown, either directly or indirectly, to deliver the epitope into a cell and to proteasomes of the cell. For example, certain "CD8+ T-cell epitope delivering" molecules pass through an endosomal compartment of the cell, such as, e.g. after endocytotic entry into that cell. Alternatively, "CD8+ T-cell epitope delivering" activity may be observed for a molecule starting at an extracellular location whereby the molecule does not enter any endosomal compartment of a cell—instead the "CD8+ T-cell epitope delivering" molecule enters a cell and delivers a T-cell epitope-peptide to proteasomes of the cell, presumably because the "CD8+ T-cell epitope delivering" molecule directed its own routing to a subcellular compartment competent to result in proteasomal cleavage of its CD8+ T-cell epitope-peptide component.

For purposes of the present invention, a Shiga toxin effector function is a biological activity conferred by a polypeptide region derived from a Shiga toxin A Subunit. Non-limiting examples of Shiga toxin effector functions include promoting cell entry; lipid membrane deformation; promoting cellular internalization; stimulating clathrin-mediated endocytosis; directing intracellular routing to various intracellular compartments such as, e.g., the Golgi, endoplasmic reticulum, and cytosol; directing intracellular routing with a cargo; inhibiting a ribosome function(s); catalytic activities, such as, e.g., N-glycosidase activity and catalytically inhibiting ribosomes; reducing protein synthesis, inducing caspase activation, activating effector caspases, effectuating cytostatic effects, and cytotoxicity. Shiga toxin catalytic activities include, for example, ribosome inactivation, protein synthesis inhibition, N-glycosidase activity, polynucleotide:adenosine glycosidase activity, RNAase activity, and DNAase activity. Shiga toxins are ribosome inactivating proteins (RIPs). RIPs can depurinate nucleic acids, polynucleosides, polynucleotides, rRNA, ssDNA, dsDNA, mRNA (and polyA), and viral nucleic acids (see e.g., Barbieri L et al., *Biochem J* 286: 1-4 (1992); Barbieri L et al., *Nature* 372: 624 (1994); Ling J et al., *FEBS Lett* 345: 143-6 (1994); Barbieri L et al., *Biochem J* 319: 507-13 (1996); Roncuzzi L, Gasperi-Campani A, *FEBS Lett* 392: 16-20 (1996); Stirpe F et al., *FEBS Lett* 382: 309-12 (1996); Barbieri L et al., *Nucleic Acids Res* 25: 518-22 (1997); Wang P, Turner N, *Nucleic Acids Res* 27: 1900-5 (1999); Barbieri L et al., *Biochim Biophys Acta* 1480: 258-66 (2000); Barbieri L et al., *J Biochem* 128: 883-9 (2000); Brigotti M et al., *Toxicon* 39: 341-8 (2001); Brigotti M et al., *FASEB J* 16: 365-72 (2002); Bagga S et al., *J Biol Chem* 278: 4813-20 (2003); Picard D et al., *J Biol Chem* 280: 20069-75 (2005)). Some RIPs show antiviral activity and superoxide dismutase activity (Erice A et al., *Antimicrob Agents Chemother* 37: 835-8 (1993); Au T et al., *FEBS Lett* 471: 169-72 (2000); Parikh B, Turner N, *Mini Rev Med Chem* 4: 523-43 (2004); Sharma N et al., *Plant Physiol* 134: 171-81 (2004)). Shiga toxin catalytic activities have been observed both in vitro and in vivo. Non-limiting examples of assays for Shiga toxin effector activity measure various activities, such as, e.g., protein synthesis inhibitory activity, depurination activity, inhibition of cell growth, cytotoxicity, supercoiled DNA relaxation activity, and nuclease activity.

As used herein, the retention of Shiga toxin effector function refers to being capable of exhibiting a level of Shiga toxin functional activity, as measured by an appropriate quantitative assay with reproducibility, comparable to a wild-type, Shiga toxin effector polypeptide control (e.g. a Shiga toxin A1 fragment) or cell-targeting molecule comprising a wild-type Shiga toxin effector polypeptide (e.g. a Shiga toxin A1 fragment) under the same conditions. For the Shiga toxin effector function of ribosome inactivation or ribosome inhibition, retained Shiga toxin effector function is exhibiting an $IC_{50}$ of 10,000 picomolar (pM) or less in an in vitro setting, such as, e.g., by using an assay known to the skilled worker and/or described herein. For the Shiga toxin effector function of cytotoxicity in a target positive cell-kill assay, retained Shiga toxin effector function is exhibiting a $CD_{50}$ of 1,000 nanomolar (nM) or less, depending on the cell-type and its expression of the appropriate extracellular target biomolecule, as shown, e.g., by using an assay known to the skilled worker and/or described herein.

For purposes of the claimed invention, the term "equivalent" with regard to ribosome inhibition means an empirically measured level of ribosome inhibitory activity, as measured by an appropriate quantitative assay with reproducibility, which is reproducibly within 10% or less of the activity of the reference molecule (e.g., the second cell-targeting molecule or third cell-targeting molecule) under the same conditions.

For purposes of the claimed invention, the term "equivalent" with regard to cytotoxicity means an empirically measured level of cytotoxicity, as measured by an appropriate quantitative assay with reproducibility, which is reproducibly within 10% or less of the activity of the reference molecule (e.g., the second cell-targeting molecule or third cell-targeting molecule) under the same conditions.

As used herein, the term "attenuated" with regard to cytotoxicity means a molecule exhibits or exhibited a $CD_{50}$ between 10-fold to 100-fold of a $CD_{50}$ exhibited by a reference molecule under the same conditions.

For some samples, accurate values for either $IC_{50}$ or $CD_{50}$ might be unobtainable due to the inability to collect the required data points for an accurate curve fit. For example, theoretically, neither an $IC_{50}$ nor $CD_{50}$ can be determined if greater than 50% ribosome inhibition or cell death, respectively, does not occur in a concentration series for a given sample. Data insufficient to accurately fit a curve as described in the analysis of the data from exemplary Shiga toxin effector function assays, such as, e.g., assays described in the Examples, should not be considered as representative of actual Shiga toxin effector function.

A failure to detect activity in Shiga toxin effector function may be due to improper expression, polypeptide folding, and/or polypeptide stability rather than a lack of cell entry, subcellular routing, and/or enzymatic activity. Assays for Shiga toxin effector functions may not require much cell-targeting molecule of the invention to measure significant amounts of Shiga toxin effector function activity. To the extent that an underlying cause of low or no effector function is determined empirically to relate to protein expression or stability, one of skill in the art may be able to compensate for such factors using protein chemistry and molecular engineering techniques known in the art, such that a Shiga toxin functional effector activity may be restored and measured. As examples, improper cell-based expression may be compensated for by using different expression control sequences; improper polypeptide folding and/or stability may benefit from stabilizing terminal sequences, or compensatory mutations in non-effector regions which stabilize the three-dimensional structure of the protein, etc. When new assays for individual Shiga toxin functions become available, Shiga toxin effector regions or polypeptides may be analyzed for any level of those Shiga toxin effector functions, such as for being within a certain-fold activity of a wild-type Shiga toxin effector polypeptide. Examples of meaningful activity differences are, e.g., Shiga toxin effector regions that have 1000-fold or 100-fold or less the activity of a wild-type Shiga toxin effector polypeptide; or that have 3-fold to 30-fold or more activity compared to a functional knock-down or knockout Shiga toxin effector polypeptide.

Certain Shiga toxin effector functions are not easily measurable, e.g. subcellular routing functions. For example, there is no routine, quantitative assay to distinguish whether the failure of a Shiga toxin effector polypeptide to be cytotoxic and/or deliver a heterologous, CD8+ T-cell epitope is due to improper subcellular routing, but at a time when tests are available, then Shiga toxin effector polypeptides may be analyzed for any significant level of subcellular routing as compared to the appropriate wild-type Shiga toxin effector polypeptide. However, if a Shiga toxin effector polypeptide component of a cell-targeting molecule of the present invention exhibits cytotoxicity comparable or equivalent to a wild-type Shiga toxin A Subunit construct, then the subcellular routing activity level is inferred to be comparable or equivalent, respectively, to the subcellular routing activity level of a wild-type Shiga toxin A Subunit construct at least under the conditions tested.

When new assays for individual Shiga toxin functions become available, Shiga toxin effector polypeptides and/or cell-targeting molecules comprising Shiga toxin effector polypeptides may be analyzed for any level of those Shiga toxin effector functions, such as a being within 1000-fold or 100-fold or less the activity of a wild-type Shiga toxin effector polypeptide or exhibiting 3-fold to 30-fold or greater activity as compared to a functional knockout, Shiga toxin effector polypeptide.

Sufficient subcellular routing may be merely deduced by observing a cell-targeting molecule's Shiga toxin cytotoxic activity levels in cytotoxicity assays, such as, e.g., cytotoxicity assays based on T-cell epitope presentation or based on a Shiga toxin effector function involving a cytosolic and/or endoplasmic reticulum-localized, target substrate.

As used herein, the retention of "significant" Shiga toxin effector function refers being capable of exhibiting a level of Shiga toxin functional activity, as measured by an appropriate quantitative assay with reproducibility comparable to a wild-type Shiga toxin effector polypeptide control (e.g. a Shiga toxin A1 fragment). For in vitro ribosome inhibition, significant Shiga toxin effector function is exhibiting an $IC_{50}$ of 300 pM or less depending on the source of the ribosomes used in the assay (e.g. a bacterial, archaeal, or eukaryotic (algal, fungal, plant, or animal) source). This is significantly greater inhibition as compared to the approximate $IC_{50}$ of 100,000 pM for the catalytically disrupted SLT-1A1-251 double mutant (Y77S/E167D). For cytotoxicity in a target-positive cell-kill assay in laboratory cell culture, significant Shiga toxin effector function is exhibiting a $CD_{50}$ of 100, 50, 30 nM, or less, depending on the target biomolecule(s) of the binding region and the cell-type, particularly that cell-type's expression and/or cell-surface representation of the appropriate extracellular target biomolecule(s) and/or the extracellular epitope(s) targeted by the molecule being evaluated. This is significantly greater cytotoxicity to the appropriate, target-positive cell population as compared to a Shiga toxin A Subunit alone (or a wild-type Shiga toxin A1 fragment), without a cell targeting binding region, which has a $CD_{50}$ of 100-10,000 nM, depending on the cell line.

For purposes of the present invention and with regard to the Shiga toxin effector function of a molecule of the present invention, the term "reasonable activity" refers to exhibiting at least a moderate level (e.g. within 11-fold to 1,000-fold) of Shiga toxin effector activity as defined herein in relation to a molecule comprising a naturally occurring Shiga toxin, wherein the Shiga toxin effector activity is selected from the group consisting of: internalization efficiency, subcellular routing efficiency to the cytosol, delivered epitope presentation by a target cell(s), ribosome inhibition, and cytotoxicity. For cytotoxicity, a reasonable level of Shiga toxin effector activity includes being within 1,000-fold of a wild-type, Shiga toxin construct, such as, e.g., exhibiting a $CD_{50}$ of 500 nM or less when a wild-type Shiga toxin construct exhibits a $CD_{50}$ of 0.5 nM (e.g. a cell-targeting molecule comprising a wild-type Shiga toxin A1 fragment).

For purposes of the present invention and with regard to the cytotoxicity of a molecule of the present invention, the term "optimal" refers to a level of Shiga toxin catalytic domain mediated cytotoxicity that is within 2, 3, 4, 5, 6, 7, 8, 9, or 10-fold of the cytotoxicity of a molecule comprising wild-type Shiga toxin A1 fragment (e.g. a Shiga toxin A Subunit or certain truncated variants thereof) and/or a naturally occurring Shiga toxin.

It should be noted that even if the cytotoxicity of a Shiga toxin effector polypeptide is reduced relative to a wild-type Shiga toxin A Subunit or fragment thereof, in practice, applications using biological activity-attenuated, Shiga toxin effector polypeptides may be equally or more effective than using wild-type Shiga toxin effector polypeptides because the highest potency variants might exhibit undesirable effects which are minimized or reduced in reduced cytotoxic-potency variants. Wild-type Shiga toxins are very potent, being able to kill an intoxicated cell after only one toxin molecule has reached the cytosol of the intoxicated cell or perhaps after only forty toxin molecules have been internalized into the intoxicated cell. Shiga toxin effector polypeptides with even considerably reduced Shiga toxin effector functions, such as, e.g., subcellular routing or cytotoxicity, as compared to wild-type Shiga toxin effector polypeptides may still be potent enough for practical applications, such as, e.g., applications involving targeted cell-killing, heterologous epitope delivery, and/or detection of specific cells and their subcellular compartments. In addition, certain reduced-activity Shiga toxin effector polypeptides may be particularly useful for delivering cargos (e.g. an additional exogenous material or T-cell epitope) to certain intracellular locations or subcellular compartments of target cells.

The term "selective cytotoxicity" with regard to the cytotoxic activity of a molecule refers to the relative level of cytotoxicity between a biomolecule target positive cell population (e.g. a targeted cell-type) and a non-targeted bystander cell population (e.g. a biomolecule target negative cell-type), which can be expressed as a ratio of the half-maximal cytotoxic concentration ($CD_{50}$) for a targeted cell-type over the $CD_{50}$ for an untargeted cell-type to provide a metric of cytotoxic selectivity or indication of the preferentiality of killing of a targeted cell versus an untargeted cell.

The cell surface representation and/or density of a given extracellular target biomolecule (or extracellular epitope of a given target biomolecule) may influence the applications for which certain cell-targeting molecules of the present invention may be most suitably used. Differences in cell surface representation and/or density of a given target biomolecule between cells may alter, both quantitatively and qualitatively, the efficiency of cellular internalization and/or cytotoxicity potency of a given cell-targeting molecule of the present invention. The cell surface representation and/or density of a given target biomolecule can vary greatly among target biomolecule positive cells or even on the same cell at different points in the cell cycle or cell differentiation. The total cell surface representation of a given target biomolecule and/or of certain extracellular epitopes of a given target biomolecule on a particular cell or population of cells may be determined using methods known to the skilled worker, such as methods involving fluorescence-activated cell sorting (FACS) flow cytometry.

For purposes of the present invention, the phrase "target biomolecule natively present on the surface of a cell" means a cell expresses the target biomolecule using its own internal machinery and localizes the target biomolecule to a cellular surface using its own internal machinery such that the target biomolecule is physically coupled to said cell and at least a part of the target biomolecule is accessible from an extracellular space, i.e. on the surface of a cell.

As used herein, the terms "disrupted," "disruption," or "disrupting," and grammatical variants thereof, with regard to a polypeptide region or feature within a polypeptide refers to an alteration of at least one amino acid within the region or composing the disrupted feature. Amino acid alterations include various mutations, such as, e.g., a deletion, inversion, insertion, or substitution which alter the amino acid sequence of the polypeptide. Amino acid alterations also include chemical changes, such as, e.g., the alteration one or more atoms in an amino acid functional group or the addition of one or more atoms to an amino acid functional group.

As used herein, "de-immunized" means reduced antigenic and/or immunogenic potential after administration to a chordate as compared to a reference molecule, such as, e.g., a wild-type peptide region, polypeptide region, or polypeptide. This includes a reduction in overall antigenic and/or immunogenic potential despite the introduction of one or more, de novo, antigenic and/or immunogenic epitopes as compared to a reference molecule. For certain embodiments, "de-immunized" means a molecule exhibited reduced antigenicity and/or immunogenicity after administration to a mammal as compared to a "parental" molecule from which it was derived, such as, e.g., a wild-type Shiga toxin A1 fragment. In certain embodiments, the de-immunized, Shiga toxin effector polypeptide of the present invention is capable of exhibiting a relative antigenicity compared to a reference molecule which is reduced by 10%, 20%, 30%, 40%, 50%, 60%, 70%, 80%, 90%, or greater than the antigenicity of the reference molecule under the same conditions measured by the same assay, such as, e.g., an assay known to the skilled worker and/or described herein like a quantitative ELISA or Western blot analysis. In certain embodiments, the de-immunized, Shiga toxin effector polypeptide of the present invention is capable of exhibiting a relative immunogenicity compared to a reference molecule which is reduced by 10%, 20%, 30%, 40%, 50%, 60%, 70%, 80%, 90%, 95%, 97%, 99%, or greater than the immunogenicity of the reference molecule under the same conditions measured by the same assay, such as, e.g., an assay known to the skilled worker and/or described herein like a quantitative measurement of anti-molecule antibodies produced in a mammal(s) after receiving parenteral administration of the molecule at a given time-point. The relative immunogenicities of exemplary cell-targeting molecules may be determined using an assay for adaptive immune reactions (e.g. in vivo antibody responses) or innate immune reactions to the cell-targeting molecules after repeat, parenteral administrations over periods of days, weeks, and/or months.

The relative immunogenicities of exemplary cell-targeting molecules were determined using an assay for in vivo antibody responses to the cell-targeting molecules after repeat, parenteral administrations over periods of many.

For purposes of the present invention, the phrase "CD8+ T-cell hyper-immunized" means that the cell-targeting molecule, when present inside a nucleated, chordate cell within a living chordate, has an increased antigenic and/or immunogenic potential regarding CD8+ T-cell antigenicity or immunogenicity when compared to the same molecule that lacks any heterologous, CD8+ T-cell epitope-peptide.

The term "embedded" and grammatical variants thereof with regard to a T-cell epitope or T-cell epitope-peptide component of a polypeptide refers to the internal replacement of one or more amino acids within a polypeptide region with different amino acids in order to generate a new polypeptide sequence sharing the same total number of amino acid residues with the starting polypeptide region. Thus, the term "embedded" does not include any external, terminal fusion of any additional amino acid, peptide, or polypeptide component to the starting polypeptide nor any additional internal insertion of any additional amino acid residues, but rather includes only substitutions for existing amino acids. The internal replacement may be accomplished merely by amino acid residue substitution or by a series of substitutions, deletions, insertions, and/or inversions. If an insertion of one or more amino acids is used, then the equivalent number of proximal amino acids must be deleted next to the insertion to result in an embedded T-cell epitope. This is in contrast to use of the term "inserted" with regard to a T-cell epitope contained within a polypeptide of the present invention to refer to the insertion of one or more amino acids internally within a polypeptide resulting in a new polypeptide having an increased number of amino acids residues compared to the starting polypeptide.

The term "inserted" and grammatical variants thereof with regard to a T-cell epitope contained within a polypeptide refers to the insertion of one or more amino acids within a polypeptide resulting in a new polypeptide sequence having an increased number of amino acids residues compared to the starting polypeptide.

For purposes of the present invention, the phrase "proximal to an amino terminus" with reference to the position of a Shiga toxin effector polypeptide region of a cell-targeting molecule of the present invention refers to a distance wherein at least one amino acid residue of the Shiga toxin effector polypeptide region is within 1, 2, 3, 4, 5, 6, 7, 8, 9, 10, 11, 12 or more, e.g., up to 18-20 amino acid residues, of an amino terminus of the cell-targeting molecule as long as the cell-targeting molecule is capable of exhibiting the appropriate level of Shiga toxin effector functional activity noted herein (e.g., a certain level of cytotoxic potency). Thus for certain embodiments of the present invention, any amino acid residue(s) fused amino-terminal to the Shiga toxin effector polypeptide should not reduce any Shiga toxin effector function (e.g., by sterically hindering a structure(s) near the amino terminus of the Shiga toxin effector polypeptide region) such that a functional activity of the Shiga toxin effector polypeptide is reduced below the appropriate activity level required herein.

For purposes of the present invention, the phrase "more proximal to an amino terminus" with reference to the position of a Shiga toxin effector polypeptide region within a cell-targeting molecule of the present invention as compared to another component (e.g., a cell-targeting, binding region, molecular moiety, and/or additional exogenous material) refers to a position wherein at least one amino acid residue of the amino terminus of the Shiga toxin effector polypeptide is closer to the amino terminus of a linear, polypeptide component of the cell-targeting molecule of the present invention as compared to the other referenced component.

For purposes of the present invention, the phrase "active enzymatic domain derived from one A Subunit of a member of the Shiga toxin family" refers to having the ability to inhibit protein synthesis via a catalytic ribosome inactivation mechanism. The enzymatic activities of naturally occurring Shiga toxins may be defined by the ability to inhibit protein translation using assays known to the skilled worker, such as, e.g., in vitro assays involving RNA translation in the absence of living cells or in vivo assays involving RNA translation in a living cell. Using assays known to the skilled worker and/or described herein, the potency of a Shiga toxin enzymatic activity may be assessed directly by observing N-glycosidase activity toward ribosomal RNA (rRNA), such as, e.g., a ribosome nicking assay, and/or indirectly by observing inhibition of ribosome function and/or protein synthesis.

For purposes of the present invention, the term "Shiga toxin A1 fragment region" refers to a polypeptide region consisting essentially of a Shiga toxin A1 fragment and/or derived from a Shiga toxin A1 fragment of a Shiga toxin.

For purposes of the present invention, the terms "terminus," "amino terminus," or "carboxy terminus" with regard to a cell-targeting molecule refers generally to the last amino acid residue of a polypeptide chain of the cell-targeting molecule (e.g., a single, continuous polypeptide chain). A cell-targeting molecule may comprise more than one polypeptides or proteins, and, thus, a cell-targeting molecule of the present invention may comprise multiple amino-terminals and carboxy-terminals. For example, the "amino terminus" of a cell-targeting molecule may be defined by the first amino acid residue of a polypeptide chain representing the amino-terminal end of the polypeptide, which is generally characterized by a starting, amino acid residue which does not have a peptide bond with any amino acid residue involving the primary amino group of the starting amino acid residue or involving the equivalent nitrogen for starting amino acid residues which are members of the class of N-alkylated alpha amino acid residues. Similarly, the "carboxy terminus" of a cell-targeting molecule may be defined by the last amino acid residue of a polypeptide chain representing the carboxyl-terminal end of the polypeptide, which is generally characterized by a final, amino acid residue which does not have any amino acid residue linked by a peptide bond to the alpha-carbon of its primary carboxyl group.

For purposes of the present invention, the phrase "Shiga toxin A1 fragment derived region" refers to all or part of a Shiga toxin effector polypeptide wherein the region consists of a polypeptide homologous to a naturally occurring Shiga toxin A1 fragment or truncation thereof, such as, e.g., a polypeptide consisting of or comprising amino acids 75-239 of SLT-1A (SEQ ID NO:1), 75-239 of StxA (SEQ ID NO:2), or 77-238 of (SEQ ID NO:3) or the equivalent region in another A Subunit of a member of the Shiga toxin family. The carboxy-terminus of a "Shiga toxin A1 fragment derived region" is defined, relative to a naturally occurring Shiga toxin A1 fragment, (1) as ending with the carboxy-terminal amino acid residue sharing homology with a naturally occurring, Shiga toxin A1 fragment; (2) as ending at the junction of the A1 fragment and the A2 fragment; (3) as ending with a furin-cleavage site or disrupted furin-cleave site; and/or (4) as ending with a carboxy-terminal truncation of a Shiga toxin A1 fragment, i.e. the carboxy-terminal amino acid residue sharing homology with a naturally occurring, Shiga toxin A1 fragment.

For purposes of the present invention, the phrase "carboxy terminus region of a Shiga toxin A1 fragment" refers to a polypeptide region derived from a naturally occurring Shiga toxin A1 fragment, the region beginning with a hydrophobic residue (e.g., V236 of StxA-A1 and SLT-1A1, and V235 of SLT-2A1) that is followed by a hydrophobic residue and the region ending with the furin-cleavage site conserved among Shiga toxin A1 fragment polypeptides and ending at the junction between the A1 fragment and the A2 fragment in native, Shiga toxin A Subunits. For purposes of the present invention, the carboxy-terminal region of a Shiga toxin A1 fragment includes a peptidic region derived from the carboxy terminus of a Shiga toxin A1 fragment polypeptide, such as, e.g., a peptidic region comprising or consisting essentially of the carboxy terminus of a Shiga toxin A1 fragment. Non-limiting examples of peptidic regions derived from the carboxy terminus of a Shiga toxin A1 fragment include the amino acid residue sequences natively positioned from position 236 to position 239, 240, 241, 242, 243, 244, 245, 246, 247, 248, 249, 250, or 251 in Shiga toxin A subunit variants (SEQ ID NOs: 1-2 and 4-6); and from position 235 to position 239, 240, 241, 242, 243, 244, 245, 246, 247, 248, 249, or 250 in SLT-2A variants (SEQ ID NOs: 3 and 7-18).

For purposes of the present invention, the phrase "proximal to the carboxy terminus of an A1 fragment polypeptide" with regard to a linked molecular moiety and/or binding region refers to being within 1, 2, 3, 4, 5, 6, 7, 8, 9, 10, 11, or 12 amino acid residues from the amino acid residue defining the last residue of the Shiga toxin A1 fragment polypeptide.

For purposes of the present invention, the phrase "sterically covers the carboxy terminus of the A1 fragment-derived region" includes any molecular moiety of a size of 4.5 kDa or greater (e.g., an immunoglobulin-type binding region) linked and/or fused to an amino acid residue in the carboxy terminus of the A1 fragment-derived region, such as, e.g., the amino acid residue derived from the amino acid residue natively positioned at any one of positions 236 to 251 in Shiga toxin variants (SEQ ID NOs. 1-2 and 4-6) or from 235 to 250 in SLT-2A variants (SEQ ID NOs: 3 and 7-18). For purposes of the present invention, the phrase "sterically covers the carboxy terminus of the A1 fragment-derived region" also includes any molecular moiety of a size of 4.5 kDa or greater (e.g., an immunoglobulin-type binding region) linked and/or fused to an amino acid residue in the carboxy terminus of the A1 fragment-derived region, such as, e.g., the amino acid residue carboxy-terminal to the last amino acid A1 fragment-derived region and/or the Shiga toxin effector polypeptide. For purposes of the present invention, the phrase "sterically covers the carboxy terminus of the A1 fragment-derived region" also includes any molecular moiety of a size of 4.5 kDa or greater (e.g., an immunoglobulin-type binding region) physically preventing cellular recognition of the carboxy terminus of the A1 fragment-derived region, such as, e.g. recognition by the ERAD machinery of a eukaryotic cell.

For purposes of the present invention, a binding region, such as, e.g., an immunoglobulin-type binding region, that comprises a polypeptide comprising at least forty amino acids and that is linked (e.g., fused) to the carboxy terminus of the Shiga toxin effector polypeptide region comprising an A1 fragment-derived region is a molecular moiety which is "sterically covering the carboxy terminus of the A1 fragment-derived region."

For purposes of the present invention, a binding region, such as, e.g., an immunoglobulin-type binding region, that comprises a polypeptide comprising at least forty amino acids and that is linked (e.g., fused) to the carboxy terminus of the Shiga toxin effector polypeptide region comprising an A1 fragment-derived region is a molecular moiety "encumbering the carboxy terminus of the A1 fragment-derived region."

For purposes of the present invention, the term "A1 fragment of a member of the Shiga toxin family" refers to the remaining amino-terminal fragment of a Shiga toxin A Subunit after proteolysis by furin at the furin-cleavage site conserved among Shiga toxin A Subunits and positioned between the A1 fragment and the A2 fragment in wild-type Shiga toxin A Subunits.

For purposes of the claimed invention, the phrase "furin-cleavage motif at the carboxy terminus of the A1 fragment region" refers to a specific, furin-cleavage motif conserved among Shiga toxin A Subunits and bridging the junction between the A1 fragment and the A2 fragment in naturally occurring, Shiga toxin A Subunits.

For purposes of the present invention, the phrase "furin-cleavage site proximal to the carboxy terminus of the A1 fragment region" refers to any identifiable, furin-cleavage site having an amino acid residue within a distance of less than 1, 2, 3, 4, 5, 6, 7, or more amino acid residues of the amino acid residue defining the last amino acid residue in the A1 fragment region or A1 fragment derived region, including a furin-cleavage motif located carboxy-terminal of an A1 fragment region or A1 fragment derived region, such as, e.g., at a position proximal to the linkage of the A1 fragment-derived region to another component of the molecule, such as, e.g., a molecular moiety of a cell-targeting molecule of the present invention.

For purposes of the present invention, the phrase "disrupted furin-cleavage motif" refers to (i) a specific furin-cleavage motif as described herein and (ii) which comprises a mutation and/or truncation that can confer a molecule with a reduction in furin-cleavage as compared to a reference molecule, such as, e.g., a reduction in furin-cleavage reproducibly observed to be 30%, 40%, 50%, 60%, 70%, 80%, 90%, 95%, 97%, 98%, 99%, or less (including 100% for no cleavage) than the furin-cleavage of a reference molecule observed in the same assay under the same conditions. The percentage of furin-cleavage as compared to a reference molecule can be expressed as a ratio of cleaved:uncleaved material of the molecule of interest divided by the cleaved:uncleaved material of the reference molecule (see e.g. WO 2015/191764; US 2016/0177284). Non-limiting examples of suitable reference molecules include certain molecules comprising a wild-type Shiga toxin furin-cleavage motif and/or furin-cleavage site as described herein and/or molecules used in the Examples below.

For purposes of the present invention, the phrase "furin-cleavage resistant" means a molecule or specific polypeptide region thereof exhibits reproducibly less furin cleavage than (i) the carboxy terminus of a Shiga toxin A1 fragment in a wild-type Shiga toxin A Subunit or (ii) the carboxy terminus of the Shiga toxin A1 fragment derived region of construct wherein the naturally occurring furin-cleavage site natively positioned at the junction between the A1 and A2 fragments is not disrupted; as assayed by any available means to the skilled worker, including by using a method described herein.

For purposes of the present invention, the phrase "active enzymatic domain derived form an A Subunit of a member of the Shiga toxin family" refers to a polypeptide structure having the ability to inhibit protein synthesis via catalytic inactivation of a ribosome based on a Shiga toxin enzymatic activity. The ability of a molecular structure to exhibit inhibitory activity of protein synthesis and/or catalytic inactivation of a ribosome may be observed using various assays known to the skilled worker, such as, e.g., in vitro assays involving RNA translation assays in the absence of living cells or in vivo assays involving the ribosomes of living cells. For example, using assays known to the skilled worker, the enzymatic activity of a molecule based on a Shiga toxin enzymatic activity may be assessed directly by observing N-glycosidase activity toward ribosomal RNA (rRNA), such as, e.g., a ribosome nicking assay, and/or indirectly by observing inhibition of ribosome function, RNA translation, and/or protein synthesis.

As used herein with respect to a Shiga toxin effector polypeptide, a "combination" describes a Shiga toxin effector polypeptide comprising two or more sub-regions wherein each sub-region comprises at least one of the following: (1) a disruption in an endogenous epitope or epitope region and (2) a disrupted furin-cleavage motif at the carboxy terminus of a Shiga toxin A1 fragment derived region.

As used herein, the term "multivalent" with regard to a cell-targeting molecule refers to an individual target-binding molecule or plurality of target-binding molecules comprising two or more high-affinity binding regions, such as, e.g. a protein comprising two or more binding regions wherein each individual binding region has a dissociation constant of $10^{-5}$ to $10^{-12}$ moles per liter toward an extracellular part of a target biomolecule.

As used herein, the term "monomeric" with regard to describing a protein and/or proteinaceous molecule refers to a molecule comprising only one polypeptide component consisting of a single, continuous polypeptide, regardless of its secondary or tertiary structure, which may be synthesized by a ribosome from a single polynucleotide template, including a continuous linear polypeptide which later forms a cyclic structure. In contrast, a multimeric molecule comprises two or more polypeptides (e.g. subunits) which together do not form a single, continuous polypeptide that may be synthesized by a ribosome from a single polynucleotide template.

As used herein, the term "multimeric" with regard to describing a protein and/or proteinaceous molecule refers to a molecule that comprises two or more, individual, polypeptide components associated together and/or linked together, such as, e.g., a molecule consisting of two components each of which is its own continuous polypeptide. For example, the association or linkage between components of a molecule may include 1) one or more non-covalent interactions; 2) one or more post-translational, covalent interactions; 3) one or more, covalent chemical conjugations; and/or 4) one or more covalent interactions resulting in a single molecule comprising a non-linear polypeptide, such as, e.g., a branched or cyclic polypeptide structure, resulting from the arrangement of the two or more polypeptide components. A molecule comprising two, discontinuous polypeptides as a result of the proteolytic cleavage of one or more peptide bonds in a single, continuous polypeptide synthesized by a ribosome from a single polynucleotide templates is "multimeric" and not "monomeric."

The present invention is described more fully hereinafter using illustrative, non-limiting embodiments, and references to the accompanying figures. This invention may, however, be embodied in many different forms and should not be construed as to be limited to the embodiments set forth below. Rather, these embodiments are provided so that this disclosure is thorough and conveys the scope of the invention to those skilled in the art.

INTRODUCTION

It may be possible to harness the power of the immune system by inducing infection-like immune reactions specifically toward malignant cells (e.g. tumor cells) and/or malignant tissue loci (e.g. tumors) within a patient specifically by using a highly immunogenic, foreign epitope from infectious agent in order to locally activate a variety of beneficial immune responses and to specifically mark targeted cells (e.g. tumor cells) as being foreign by inducing an imitation of an infected state. Alternatively, this approach could use highly immunogenic neoepitopes (derived from either infectious or non-infectious agents) or highly immunogenic, non-self epitopes derived from non-infectious agents, such as, e.g., tumor-specific antigens, tumor-associated antigens, and molecules from plants, fungi, etc.

The present invention exploits the abilities of Shiga toxin A Subunit derived polypeptides to drive their own subcellular routing in order to deliver highly immunogenic, CD8+ T-cell antigens, such as e.g. peptide-epitopes, to the MHC class I presentation system of a chordate cell. The present invention provides various exemplary, Shiga toxin A Subunit derived constructs capable of delivering heterologous, CD8+ T-cell epitopes to the MHC class I system of a target cell resulting in cell-surface presentation of the delivered epitope wherein the Shiga toxin effector polypeptide components comprise a combination of mutations providing (1) de-immunization, (2) a reduction in protease sensitivity, and/or (3) an embedded, T-cell epitope(s). Certain peptide-epitopes presented in complexes with MHC class I molecules on a cellular surface can signal CD8+ effector T-cells to kill the presenting cell as well as stimulate other immune responses in the local area. Thus, the present invention provides Shiga toxin A Subunit derived, cell-targeting molecules which kill specific target cells, such as, e.g., via presentation of certain CD8+ T-cell epitope-peptides by the MHC class I pathway. The cell-targeting molecules of the present invention may be utilized, e.g., as cell-killing molecules, cytotoxic therapeutics, therapeutic delivery agents, and diagnostic molecules.

I. The General Structure of the Cell-Targeting Molecules of the Present Invention The cell-targeting molecules of the present invention each comprise 1) a cell-targeting binding region, 2) a Shiga toxin A Subunit effector polypeptide, and 3) a CD8+ T-cell epitope-peptide which is not embedded or inserted in the Shiga toxin A1 fragment region and which is heterologous to Shiga toxin A Subunits and the binding region of the molecule. This system is modular, in that any number of diverse, CD8+ T-cell epitope-peptides may be used as cargos for delivery to the MHC class I presentation pathway of target cells by the cell-targeting molecules of the present invention.

A. The General Structures of the Shiga Toxin Effector Polypeptide Components of the Cell-Targeting Molecules of the Present Invention The Shiga toxin effector polypeptides and cell-targeting molecules of the present invention comprise at least one, Shiga toxin effector polypeptide derived from wild-type Shiga toxin A Subunits but comprise one or more structural modifications, such as, e.g., a mutation like a truncation and/or amino acid residue substitution(s). For certain embodiments, the present invention involves the engineering of improved, Shiga toxin A Subunit effector polypeptides comprising the combination of two or more of the following Shiga toxin effector polypeptide sub-regions: (1) a de-immunized sub-region, (2) a protease-cleavage resistant sub-region near the carboxy-terminus of a Shiga toxin A1 fragment region, and (3) a T-cell epitope-peptide embedded or inserted sub-region.

A Shiga toxin effector polypeptide of a cell-targeting molecule of the present invention is a polypeptide derived from a Shiga toxin A Subunit member of the Shiga toxin family that is capable of exhibiting one or more Shiga toxin functions. There are numerous Shiga toxin effector polypeptides that are suitable for use in the present invention or to use as parental polypeptides to be modified into a Shiga toxin effector polypeptide of the present invention using techniques known the art (see e.g., Cheung M et al., *Mol Cancer* 9: 28 (2010); WO 2014/164693; WO 2015/113005; WO 2015/113007; WO 2015/138452; WO 2015/191764). Shiga toxin functions include, e.g., promoting cell entry, increasing cellular internalization, directing retrograde transport, directing subcellular routing, directing subcellular routing from an endosomal compartment to the cytosol, avoiding intracellular degradation, catalytically inactivating ribosomes, effectuating cytotoxicity, and effectuating cytostatic effects.

The Shiga toxin family of protein toxins is composed of various naturally occurring toxins which are structurally and functionally related, e.g., Shiga toxin, Shiga-like toxin 1, and Shiga-like toxin 2 (Johannes L, Römer W, *Nat Rev Microbiol* 8: 105-16 (2010)). Holotoxin members of the Shiga toxin family contain targeting domains that preferentially bind a specific glycosphingolipid present on the surface of some host cells and an enzymatic domain capable of permanently inactivating ribosomes once inside a cell (Johannes L, Römer W, *Nat Rev Microbiol* 8: 105-16 (2010)). Members of the Shiga toxin family share the same overall structure and mechanism of action (Engedal N et al., *Microbial Biotech* 4: 32-46 (2011)). For example, Stx, SLT-1 and SLT-2 display indistinguishable enzymatic activity in cell free systems (Head S et al., *J Biol Chem* 266: 3617-21 (1991); Tesh V et al., *Infect Immun* 61: 3392-402 (1993); Brigotti M et al., *Toxicon* 35: 1431-7 (1997)).

The Shiga toxin family encompasses true Shiga toxin (Stx) isolated from *S. dysenteriae* serotype 1, Shiga-like toxin 1 variants (SLT1 or Stx1 or SLT-1 or Slt-I) isolated from serotypes of enterohemorrhagic *E. coli*, and Shiga-like toxin 2 variants (SLT2 or Stx2 or SLT-2) isolated from serotypes of enterohemorrhagic *E. coli*. SLT1 differs by only one amino acid residue from Stx, and both have been referred to as Verocytotoxins or Verotoxins (VTs) (O'Brien A, *Curr Top Microbiol Immunol* 180: 65-94 (1992)). Although SLT1 and SLT2 variants are only about 53-60% similar to each other at the primary amino acid sequence level, they share mechanisms of enzymatic activity and cytotoxicity common to the members of the Shiga toxin family (Johannes L, Römer W, *Nat Rev Microbiol* 8: 105-16 (2010)). Over 39 different Shiga toxins have been described, such as the defined subtypes Stx1a, Stx1c, Stx1d, Stx1e, Stx2a-g, and Stx2dact (Scheutz F et al., *J Clin Microbiol* 50: 2951-63 (2012); Probert W et al., *J Clin Microbiol* 52: 2346-51 (2014)). Members of the Shiga toxin family are not naturally restricted to any bacterial species because Shiga-toxin-encoding genes can spread among bacterial species via horizontal gene transfer (Strauch E et al., *Infect Immun* 69: 7588-95 (2001); Bielaszewska M et al., *Appl Environ Micrbiol* 73: 3144-50 (2007); Zhaxybayeva O, Doolittle W, *Curr Biol* 21: R242-6 (2011); Kruger A, Lucchesi P, *Microbiology* 161: 451-62 (2015)). As an example of interspecies transfer, a Shiga toxin was discovered in a strain of *A. haemolyticus* isolated from a patient (Grotiuz G et al., *J Clin Microbiol* 44: 3838-41 (2006)). Once a Shiga toxin encoding polynucleotide enters a new subspecies or species, the Shiga toxin amino acid sequence is presumed to be capable of developing slight sequence variations due to genetic drift and/or selective pressure while still maintaining a mechanism of cytotoxicity common to members of the Shiga toxin family (see Scheutz F et al., *J Clin Microbiol* 50: 2951-63 (2012)).

1. De-Immunized, Shiga Toxin A Subunit Effector Polypeptides

In certain embodiments, the Shiga toxin effector polypeptide of the present invention is de-immunized, such as, e.g., as compared to a wild-type Shiga toxin, wild-type Shiga toxin polypeptide, and/or Shiga toxin effector polypeptide comprising only wild-type polypeptide sequences. The de-immunized, Shiga toxin effector polypeptides of the present invention each comprise a disruption of at least one, putative, endogenous, epitope region in order to reduce the antigenic and/or immunogenic potential of the Shiga toxin effector polypeptide after administration of the polypeptide to a chordate. A Shiga toxin effector polypeptide and/or Shiga toxin A Subunit polypeptide, whether naturally occurring or not, can be de-immunized by a method described herein, described in WO 2015/113005, WO 2015/113007, and/or WO 2016/196344, and/or known to the skilled worker, wherein the resulting molecule retains one or more Shiga toxin A Subunit functions.

Shiga toxin effector polypeptides of the present invention comprise or consist essentially of a polypeptide derived from a Shiga toxin A Subunit dissociated from any form of its native Shiga toxin B Subunit. The Shiga toxin effector polypeptides of the present invention do not comprise the cell-targeting domain of a Shiga toxin B Subunit. Archetypal Shiga toxins naturally target the human cell-surface receptors globotriaosylceramide (Gb3, Gb3Cer, or CD77) and globotetraosylceramide (Gb4 or Gb4Cer) via the Shiga toxin B Subunit, which severely limits potential applications by restricting targeting cell-types and potentially unwanted targeting of vascular endothelial cells, certain renal epithelial cells, and/or respiratory epithelial cells (Tesh V et al., *Infect Immun* 61: 3392-402 (1993); Ling H et al., *Biochemistry* 37: 1777-88 (1998); Bast D et al., *Mol Microbiol* 32: 953-60 (1999); Rutjes N et al., *Kidney Int* 62: 832-45 (2002); Shimizu T et al., *Microb Pathog* 43: 88-95 (2007); Pina D et al., *Biochim Biophys Acla* 1768: 628-36 (2007); Shin I et al., *BMB Rep* 42: 310-4 (2009); Zumbrun S et al., *Infect Immun* 4488-99 (2010); Engedal N et al., *Microb Biotechnol* 4: 32-46 (2011); Gallegos K et al., *PLoS ONE* 7: e30368 (2012); Ståhl A et al., *PLoS Pathog* 11: e1004619 (2015)). Gb3 and Gb4 are a common, neutral sphingolipid present on the extracellular leaflet of cell membranes of various, healthy cell-types, such as polymorphonuclear leukocytes and human endothelial cells from various vascular beds. The cell-targeting molecules of the present invention do not comprise any polypeptide comprising or consisting essentially of a functional binding domain of a native Shiga toxin B subunit. Rather, the Shiga toxin effector polypeptides of the present invention may be functionally associated with heterologous binding regions to effectuate cell targeting.

In certain embodiments, a Shiga toxin effector polypeptide of the present invention may comprise or consist essentially of a full-length Shiga toxin A Subunit (e.g. any one of SEQ ID NOs: 1-18), noting that naturally occurring Shiga toxin A Subunits may comprise precursor forms containing signal sequences of about 22 amino acids at their amino-terminals which are removed to produce mature Shiga toxin A Subunits and are recognizable to the skilled worker. In other embodiments, the Shiga toxin effector polypeptide of the invention comprises or consists essentially of a truncated Shiga toxin A Subunit which is shorter than a full-length Shiga toxin A Subunit, such as, e.g., a truncation known in the art (see e.g., WO 2014/164693; WO 2015/113005; WO 2015/113007; WO 2015/138452; WO 2015/191764).

In certain embodiments, the Shiga toxin effector polypeptide of the present invention comprises a disruption of an endogenous epitope or epitope region, such as, e.g., a B-cell and/or CD4+ T-cell epitope. In certain embodiments, the Shiga toxin effector polypeptide of the present invention comprises a disruption of at least one, endogenous, epitope region described herein, wherein the disruption reduces the antigenic and/or immunogenic potential of the Shiga toxin effector polypeptide after administration of the polypeptide to a chordate, and wherein the Shiga toxin effector polypeptide is capable of exhibiting one or more Shiga toxin A Subunit functions, such as, e.g., a significant level of Shiga toxin cytotoxicity.

The term "disrupted" or "disruption" as used herein with regard to an epitope region refers to the deletion of at least one amino acid residue in an epitope region, inversion of two or more amino acid residues where at least one of the inverted amino acid residues is in an epitope region, insertion of at least one amino acid into an epitope region, and a substitution of at least one amino acid residue in an epitope region. An epitope region disruption by mutation includes amino acid substitutions with non-standard amino acids and/or non-natural amino acids. Epitope regions may alternatively be disrupted by mutations comprising the modification of an amino acid by the addition of a covalently-linked chemical structure which masks at least one amino acid in an epitope region, see, e.g. PEGylation (see Zhang C et al., *BioDrugs* 26: 209-15 (2012), small molecule adjuvants (Flower D, *Expert Opin Drug Discov* 7: 807-17 (2012), and site-specific albumination (Lim S et al., *J Control Release* 207-93 (2015)).

Certain epitope regions and disruptions are indicated herein by reference to specific amino acid positions of native Shiga toxin A Subunits provided in the Sequence Listing, noting that naturally occurring Shiga toxin A Subunits may comprise precursor forms containing signal sequences of about 22 amino acids at their amino-terminals which are removed to produce mature Shiga toxin A Subunits and are recognizable to the skilled worker. Further, certain epitope region disruptions are indicated herein by reference to specific amino acids (e.g. S for a serine residue) natively present at specific positions within native Shiga toxin A Subunits (e.g. S33 for the serine residue at position 33 from the amino-terminus) followed by the amino acid with which that residue has been substituted in the particular mutation under discussion (e.g. S33I represents the amino acid substitution of isoleucine for serine at amino acid residue 33 from the amino-terminus).

In certain embodiments, the de-immunized, Shiga toxin effector polypeptide of the present invention comprises a disruption of at least one epitope region described in WO 2015/113005, WO 2015/113007 and/or WO 2016/196344.

In certain embodiments, the de-immunized, Shiga toxin effector polypeptide of the present invention comprises or consists essentially of a full-length Shiga toxin A Subunit (e.g. SLT-1A (SEQ ID NO:1), StxA (SEQ ID NO:2), or SLT-2A (SEQ ID NO:3), or variants thereof (e.g. SEQ ID NOs: 4-18)) comprising at least one disruption of the amino acid sequence selected from the group of natively positioned amino acids consisting of: 1-15 of any one of SEQ ID NOs: 1-2 and 4-6; 3-14 of any one of SEQ ID NOs: 3 and 7-18; 26-37 of any one of SEQ ID NOs: 3 and 7-18; 27-37 of any one of SEQ ID NOs: 1-2 and 4-6; 39-48 of any one of SEQ ID NOs: 1-2 and 4-6; 42-48 of any one of SEQ ID NOs: 3 and 7-18; and 53-66 of any one of SEQ ID NOs: 1-18; 94-115 of any one of SEQ ID NOs: 1-18; 141-153 of any one of SEQ ID NOs: 1-2 and 4-6; 140-156 of any one of SEQ ID NOs 3 and 7-18; 179-190 of any one of SEQ ID NOs: 1-2 and 4-6; 179-191 of any one of SEQ ID NOs: 3 and 7-18; 204 of SEQ ID NO:3; 205 of any one of SEQ ID NOs: 1-2 and 4-6; and 210-218 of any one of SEQ ID NOs: 3 and 7-18; 240-260 of any one of SEQ ID NOs: 3 and 7-18; 243-257 of any one of SEQ ID NOs: 1-2 and 4-6; 254-268 of any one of SEQ ID NOs: 1-2 and 4-6; 262-278 of any one of SEQ ID NOs: 3 and 7-18; 281-297 of any one of SEQ ID NOs: 3 and 7-18; and 285-293 of any one of SEQ ID NOs: 1-2 and 4-6; or the equivalent region in a Shiga toxin A Subunit polypeptide, conserved Shiga toxin effector polypeptide sub-region, and/or non-native, Shiga toxin effector polypeptide sequence.

In certain embodiments, the Shiga toxin effector polypeptide of the present invention comprises or consists essentially of a truncated Shiga toxin A Subunit. Truncations of Shiga toxin A Subunits might result in the deletion of an entire epitope region(s) without affecting Shiga toxin effector function(s). The smallest, Shiga toxin A Subunit fragment shown to exhibit significant enzymatic activity was a polypeptide composed of residues 75-247 of StxA (Al-Jaufy A et al., *Infect Immun* 62: 956-60 (1994)). Truncating the carboxy-terminus of SLT-1A, StxA, or SLT-2A to amino acids 1-251 removes two predicted B-cell epitope regions, two predicted CD4 positive (CD4+) T-cell epitopes, and a predicted, discontinuous, B-cell epitope. Truncating the amino-terminus of SLT-1A, StxA, or SLT-2A to 75-293 removes at least three, predicted, B-cell epitope regions and three predicted CD4+ T-cell epitopes. Truncating both amino- and carboxy-terminals of SLT-1A, StxA, or SLT-2A to 75-251 deletes at least five, predicted, B-cell epitope regions; four, putative, CD4+ T-cell epitopes; and one, predicted, discontinuous, B-cell epitope.

In certain embodiments, a Shiga toxin effector polypeptide of the invention may comprise or consist essentially of a full-length or truncated Shiga toxin A Subunit with at least one mutation, e.g. deletion, insertion, inversion, or substitution, in a provided epitope region. In certain further embodiments, the polypeptides comprise a disruption which comprises a deletion of at least one amino acid within the epitope region. In certain further embodiments, the polypeptides comprise a disruption which comprises an insertion of at least one amino acid within the epitope region. In certain further embodiments, the polypeptides comprise a disruption which comprises an inversion of amino acids, wherein at least one inverted amino acid is within the epitope region. In certain further embodiments, the polypeptides comprise a disruption which comprises a mutation, such as an amino acid substitution to a non-standard amino acid or an amino acid with a chemically modified side chain. Numerous examples of single amino acid substitutions are provided in the Examples below.

In certain embodiments, the Shiga toxin effector polypeptides of the invention may comprise or consist essentially of a full-length or truncated Shiga toxin A Subunit with one or more mutations as compared to the native sequence which comprises at least one amino acid substitution selected from the group consisting of: A, G, V, L, I, P, C, M, F, S, D, N, Q, H, and K. In certain further embodiments, the polypeptide may comprise or consist essentially of a full-length or truncated Shiga toxin A Subunit with a single mutation as compared to the native sequence wherein the substitution is selected from the group consisting of: D to A, D to G, D to V, D to L, D to I, D to F, D to S, D to Q, E to A, E to G, E to V, E to L, E to I, E to F, E to S, E to Q, E to N, E to D, E to M, E to R, G to A, H to A, H to G, H to V, H to L, H to I, H to F, H to M, K to A, K to G, K to V, K to L, K to I, K to M, K to H, L to A, L to G, N to A, N to G, N to V, N to L, N to I, N to F, P to A, P to G, P to F, R to A, R to G, R to V, R to L, R to I, R to F, R to M, R to Q, R to S, R to K, R to H, S to A, S to G, S to V, S to L, S to T, S to F, S to M, T to A, T to G, T to V, T to L, T to I, T to F, T to M, T to S, Y to A, Y to G, Y to V, Y to L, Y to I, Y to F, and Y to M.

In certain embodiments, the Shiga toxin effector polypeptides of the invention comprise or consist essentially of a full-length or truncated Shiga toxin A Subunit with one or more mutations as compared to the native amino acid residue sequence which comprises at least one amino acid substitution of an immunogenic residue and/or within an epitope region, wherein at least one substitution occurs at the natively positioned group of amino acids selected from the group consisting of: 1 of SEQ ID NO:1 or SEQ ID NO:2; 4 of SEQ ID NO:1, SEQ ID NO:2, or SEQ ID NO:3; 8 of SEQ ID NO:1, SEQ ID NO:2, or SEQ ID NO:3; 9 of SEQ ID NO:1, SEQ ID NO:2, or SEQ ID NO:3; 11 of SEQ ID NO:1, SEQ ID NO:2, or SEQ ID NO:3; 33 of SEQ ID NO:1 or SEQ ID NO:2; 43 of SEQ ID NO: 1 or SEQ ID NO:2; 44 of SEQ ID NO:1 or SEQ ID NO:2; 45 of SEQ ID NO:1 or SEQ ID NO:2; 46 of SEQ ID NO:1 or SEQ ID NO:2; 47 of SEQ ID NO:1 or SEQ ID NO:2; 48 of SEQ ID NO:1, SEQ ID NO:2, or SEQ ID NO:3; 49 of SEQ ID NO:1 or SEQ ID NO:2; 50 of SEQ ID NO:1 or SEQ TD NO:2; 51 of SEQ TD NO:1 or SEQ ID NO:2; 53 of SEQ ID NO:1 or SEQ ID NO:2; 54 of SEQ ID NO:1 or SEQ ID NO:2; 55 of SEQ ID NO:1 or SEQ ID NO:2; 56 of SEQ ID NO:1 or SEQ ID NO:2; 57 of SEQ ID NO:1 or SEQ ID NO:2; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO: 1 or SEQ ID NO:2; 84 of SEQ ID NO:1 or SEQ ID NO:2; 88 of SEQ ID NO:1 or SEQ ID NO:2; 94 of SEQ ID NO:1, SEQ ID NO:2, or SEQ ID NO:3; 96 of SEQ ID NO:1, SEQ ID NO:2, or SEQ ID NO:3; 104 of SEQ ID NO:1 or SEQ ID NO:2; 105 of SEQ ID NO: 1 or SEQ ID NO:2; 107 of SEQ ID NO:1 or SEQ ID NO:2; 108 of SEQ ID NO:1 or SEQ ID NO:2; 109 of SEQ ID NO:1, SEQ ID NO:2, or SEQ ID NO:3; 110 of SEQ ID NO:1 or SEQ ID NO:2; 111 of SEQ ID NO:1 or SEQ ID NO:2; 112 of SEQ ID NO: 1, SEQ ID NO:2, or SEQ ID NO:3; 141 of SEQ ID NO:1 or SEQ ID NO:2; 147 of SEQ ID NO:1, SEQ ID NO:2, or SEQ ID NO:3; 154 of SEQ ID NO:1 or SEQ ID NO:2; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 198 of SEQ ID NO:1 or SEQ ID NO:2; 204 of SEQ ID NO:3; 205 of SEQ ID NO:1 or SEQ ID NO:2; 241 of SEQ ID NO:3; 242 of SEQ ID NO:1 or SEQ ID NO:2; 247 of SEQ ID NO:1 or SEQ ID NO:2; 247 of SEQ ID NO:3; 248 of SEQ ID NO:1 or SEQ ID NO:2; 250 of SEQ ID NO:3; 251 of SEQ ID NO:1 or SEQ ID NO:2; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2.

In certain further embodiments, the Shiga toxin effector polypeptides of the invention comprise or consist essentially of a full-length or truncated Shiga toxin A Subunit with at least one substitution of an immunogenic residue and/or within an epitope region, wherein at least one amino acid substitution is to a non-conservative amino acid (see, e.g., Table B, infra) relative to a natively occurring amino acid positioned at one of the following native positions: 1 of SEQ ID NO: 1 or SEQ ID NO:2; 4 of SEQ ID NO:1, SEQ ID NO:2, or SEQ ID NO:3; 8 of SEQ ID NO:1, SEQ ID NO:2, or SEQ ID NO:3; 9 of SEQ ID NO:1, SEQ ID NO:2, or SEQ ID NO:3; 11 of SEQ ID NO:1, SEQ ID NO:2, or SEQ ID NO:3; 33 of SEQ ID NO:1 or SEQ ID NO:2; 43 of SEQ ID NO:1 or SEQ ID NO:2; 44 of SEQ ID NO:1 or SEQ ID NO:2; 45 of SEQ ID NO:1 or SEQ ID NO:2; 46 of SEQ ID NO:1 or SEQ ID NO:2; 47 of SEQ ID NO:1 or SEQ ID NO:2; 48 of SEQ ID NO:1, SEQ ID NO:2, or SEQ ID NO:3; 49 of SEQ ID NO:1 or SEQ ID NO:2; 50 of SEQ ID NO:1 or SEQ ID NO:2; 51 of SEQ ID NO:1 or SEQ ID NO:2; 53 of SEQ ID NO:2; 54 of SEQ ID NO:1 or SEQ ID NO:2; 55 of SEQ ID NO:1 or SEQ ID NO:2; 56 of SEQ ID NO:1 or SEQ ID NO:2; 57 of SEQ ID NO:1 or SEQ ID NO:2; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 84 of SEQ ID NO:1 or SEQ ID NO:2; 88 of SEQ ID NO:1 or SEQ ID NO:2; 94 of SEQ ID NO:1, SEQ ID NO:2, or SEQ ID NO:3; 96 of SEQ ID NO:1, SEQ ID NO:2, or SEQ ID NO:3; 104 of SEQ ID NO:1 or SEQ ID NO:2; 105 of SEQ ID NO:1 or SEQ ID NO:2; 107 of SEQ ID NO:1 or SEQ ID NO:2; 108 of SEQ ID NO:1 or SEQ ID NO:2; 109 of SEQ ID NO:1, SEQ ID NO:2, or SEQ ID NO:3; 110 of SEQ ID NO:1 or SEQ ID NO:2; 111 of SEQ ID NO:1 or SEQ ID NO:2; 112 of SEQ ID NO:1, SEQ ID NO:2, or SEQ ID NO:3; 141 of SEQ ID NO:1 or SEQ ID NO:2; 147 of SEQ ID NO: 1, SEQ ID NO:2, or SEQ ID NO:3; 154 of SEQ ID NO:1 or SEQ ID NO:2; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 198 of SEQ ID NO:1 or SEQ ID NO:2; 204 of SEQ ID NO:3; 205 of SEQ ID NO:1 or SEQ ID NO:2; 241 of SEQ ID NO:3; 242 of SEQ ID NO:1 or SEQ ID NO:2; 247 of SEQ ID NO:1 or SEQ ID NO:2; 247 of SEQ ID NO:3; 248 of SEQ ID NO:1 or SEQ ID NO:2; 250 of SEQ ID NO:3; 251 of SEQ ID NO:1 or SEQ ID NO:2; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2.

In certain further embodiments, the Shiga toxin effector polypeptides of the invention comprise or consist essentially of a full-length or truncated Shiga toxin A Subunit with at least one amino acid substitution selected from the group consisting of: K1 to A, G, V, L, I, F, M and H; T4 to A, G, V, L, I, F, M, and S; D6 to A, G, V, L, T, F, S, and Q; S8 to A, G, V, I, L, F, and M; T8 to A, G, V, I, L, F, M, and S; T9 to A, G, V, I, L, F, M, and S; S9 to A, G, V, L, I, F, and M; K11 to A, G, V, L, I, F, M and H; T12 to A, G, V, I, L, F, M, and S; S33 to A, G, V, L, I, F, and M; S43 to A, G, V, L, I, F, and M; G44 to A and L; S45 to A, G, V, L, I, F, and M; T45 to A, G, V, L, I, F, and M; G46 to A and P; D47 to A, G, V, L, I, F, S, and Q; N48 to A, G, V, L, and M; L49 to A or G; F50; A51 to V; D53 to A, G, V, L, I, F, S, and Q; V54 to A, G, and L; R55 to A, G, V, L, I, F, M, Q, S, K, and H; G56 to A and P; 157 to A, G, M, and F; L57 to A, G, M, and F; D58 to A, G, V, L, I, F, S, and Q; P59 to A, G, and F; E60 to A, G, V, L, I, F, S, Q, N, D, M, and R; E61 to A, G, V, L, I, F, S, Q, N, D, M, and R; G62 to A; D94 to A, G, V, L, I, F, S, and Q; R84 to A, G, V, L, I, F, M, Q, S, K, and H; V88 to A and G; 188 to A, G, and V; D94; S96 to A, G, V, I, L, F, and M; T104 to A, G, V, I, L, F, M, and S; A105 to L; T107 to A, G, V, I, L, F, M, and S; S107 to A, G, V, L, I, F, and M; L108 to A, G, and M; S109 to A, G, V, I, L, F, and M; T109 to A, G, V, I, L, F, M, and S; G110 to A; D111 to A, G, V, L, I, F, S, and Q; S112 to A, G, V, L, I, F, and M; D141 to A, G, V, L, I, F, S, and Q; G147 to A; V154 to A and G; R179 to A, G, V, L, I, F, M, Q, S, K, and H; T180 to A, G, V, L, I, F, M, and S; T181 to A, G, V, L, I, F, M, and S; D183 to A, G, V, L, I, F, S, and Q; D184 to A, G, V, L, I, F, S, and Q; L185 to A, G, and V; S186 to A, G, V, I, L, F, and M; G187 to A; R188 to A, G, V, L, I, F, M, Q, S, K, and H; S189 to A, G, V, I, L, F, and M; D197 to A, G, V, L, 1, F, S, and Q; D198 to A, G, V, L, I, F, S, and Q; R204 to A, G, V, L, I, F, M, Q, S, K, and H; R205 to A, G, V, L, I, F, M, Q, S, K and H; C242 to A, G, V, and S; S247 to A, G, V, I, L, F, and M; Y247 to A, G, V, L, I, F, and M; R248 to A, G, V, L, I, F, M, Q, S, K, and H; R250 to A, G, V, L, I, F, M, Q, S, K, and H; R251 to A, G, V, L, I, F, M, Q, S, K, and H; C262 to A, G, V, and S; D264 to A, G, V, L, I, F, S, and Q; G264 to A; and T286 to A, G, V, L, I, F, M, and S.

In certain further embodiments, the Shiga toxin effector polypeptides of the invention comprise or consist essentially of a full-length or truncated Shiga toxin A Subunit with at least one of the following amino acid substitutions K1A, K1M, T4I, D6R, S8I, T8V, T9I, S9I, K11A, K11H, T12K, S33I, S33C, S43N, G44L, S45V, S45I, T45V, T45I, G46P, D47M, D47G, N48V, N48F, L49A, F50T, A51V, D53A, D53N, D53G, V54L, V54I, R55A, R55V, R55L, G56P, I57F, I57M, D58A, D58V, D58F, P59A, P59F, E60I, E60T, E60R, E61A, E61V, E61L, G62A, R84A, V88A, D94A, S96, T104N, A105L, T107P, L108M, S109V, T109V, G110A, D111T, S112V, D141A, G147A, V154A, R179A, T180G, T181, D183A, D183G, D184A, D184A, D184F, I185V, L185D, S186A, S186F, G187A, G187T, R188A, R188L, S189A, D198A, R204A, R205A, C242S, S247I, Y247A, R248A, R250A, R251A, or D264A, G264A, T286A, and/or T286I. These epitope-disrupting substitutions may be combined to form a de-immunized, Shiga toxin effector polypeptide with multiple substitutions per epitope region and/or multiple epitope regions disrupted while still retaining Shiga toxin effector function. For example, substitutions at the natively positioned K1A, K1M, T4I, D6R, S8I, T8V, T9I, S9I, K11A, K11H, T12K, S33I, S33C, S43N, G44L, S45V, S45I, T45V, T45I, G46P, D47M, D47G, N48V, N48F, L49A, F50T, A51V, D53A, D53N, D53G, V54L, V54I, R55A, R55V, R55L, G56P, 157F, 157M, D58A, D58V, D58F, P59A, P59F, E60I, E60T, E60R, E61A, E61V, E61L, G62A, R84A, V88A, D94A, S96I, T104N, A105L, T107P, L108M, S109V, T109V, G110A, D111T, S112V, D141A, G147A, V154A, R179A, T180G, T181I, D183A, D183G, D184A, D184A, D184F, L185V, L185D, S186A, S186F, G187A, G187T, R188A, R188L, S189A, D198A, R204A, R205A, C242S, S247I, Y247A, R248A, R250A, R251A, or D264A, G264A, T286A, and/or T286I may be combined, where possible, with substitutions at the natively positioned residues K1A, K1M, T4I, D6R, S8I, T8V, T9I, S9I, K11A, K11H, T12K, S33I, S33C, S43N, G44L, S45V, 5451, T45V, T45I, G46P, D47M, D47G, N48V, N48F, L49A, F50T, A51V, D53A, D53N, D53G, V54L, V54I, R55A, R55V, R55L, G56P, 157F, 157M, D58A, D58V, D58F, P59A, P59F, E60I, E60T, E60R, E61A, E61V, E61L, G62A, R84A, V88A, D94A, S96I, T104N, A105L, T107P, L108M, S109V, T109V, G110A, D111T, S112V, D141A, G147A, V154A, R179A, T180G, T181L, D183A, D183G, D184A, D184A, D184F, L185V, L185D, S186A, S186F, G187A, G187T, R188A, R188L, S189A, D198A, R204A, R205A, C242S, S247I, Y247A, R248A, R250A, R251A, or D264A, G264A, T286A, and/or T286I to create de-immunized, Shiga toxin effector polypeptides of the invention.

Any of the de-immunized, Shiga toxin effector polypeptide sub-regions and/or epitope disrupting mutations described herein may be used alone or in combination with each individual embodiment of the present invention, including methods of the present invention.

2. Protease-Cleavage Resistant, Shiga Toxin A Subunit Effector Polypeptides

In certain embodiments, the Shiga toxin effector polypeptide of the present invention comprises (1) a Shiga toxin A1 fragment derived region having a carboxy-terminus and (2) a disrupted furin-cleavage motif at the carboxy-terminus of the Shiga toxin A1 fragment region. Improving the stability of connections between the Shiga toxin component and other components of cell-targeting molecules, e.g., cell-targeting binding regions, can improve their toxicity profiles after administration to organisms by reducing non-specific toxicities caused by the breakdown of the connection and loss of cell-targeting, such as, e.g., as a result of proteolysis.

Shiga toxin A Subunits of members of the Shiga toxin family comprise a conserved, furin-cleavage site at the carboxy-terminal of their A1 fragment regions important for Shiga toxin function. Furin-cleavage site motifs and furin-cleavage sites can be identified by the skilled worker using standard techniques and/or by using the information herein.

The model of Shiga toxin cytotoxicity is that intracellular proteolytic processing of Shiga toxin A Subunits by furin in intoxicated cells is essential for 1) liberation of the A1 fragment from the rest of the Shiga holotoxin, 2) escape of the A1 fragment from the endoplasmic reticulum by exposing a hydrophobic domain in the carboxy-terminus of the A1 fragment, and 3) enzymatic activation of the A1 fragment (see Johannes L, Römer W, Nat Rev Microbiol 8: 105-16 (2010)). The efficient liberation of the Shiga toxin A1 fragment from the A2 fragment and the rest of the components of the Shiga holotoxin in the endoplasmic reticulum of intoxicated cells is essential for efficient intracellular routing to the cytosol, maximal enzymatic activity, efficient ribosome inactivation, and achieving optimal cytotoxicity, i.e. comparable to a wild-type Shiga toxin (see e.g. WO 2015/191764 and references therein).

During Shiga toxin intoxication, the A Subunit is proteolytically cleaved by furin at the carboxy bond of a conserved arginine residue (e.g. the arginine residue at position 251 in StxA and SLT-1A variants and the arginine residue at position 250 in Stx2A and SLT-2A variants). Furin cleavage of Shiga toxin A Subunits occurs in endosomal and/or Golgi compartments. Furin is a specialized serine endoprotease which is expressed by a wide variety of cell types, in all human tissues examined, and by most animal cells. Furin cleaves polypeptides comprising accessible motifs often centered on the minimal, dibasic, consensus motif R-x-(R/K/x)-R. The A Subunits of members of the Shiga toxin family comprise a conserved, surface-exposed, extended loop structure (e.g. 242-261 in StxA and SLT-1A, and 241-260 in SLT-2) with a conserved S-R/Y-x-x-R motif which is cleaved by furin. The surface exposed, extended loop structure positioned at amino acid residues 242-261 in StxA is required for furin-induced cleavage of StxA, including features flanking the minimal, furin-cleavage motif R-x-x-R.

Furin-cleavage motifs and furin-cleavage sites in Shiga toxin A Subunits and Shiga toxin effector polypeptides can be identified by the skilled worker using standard methods and/or by using the information herein. Furin cleaves the minimal, consensus motif R-x-x-R (Schalken J et al., J Clin Invest 80: 1545-9 (1987); Bresnahan P et al., J Cell Biol 111: 2851-9 (1990); Hatsuzawa K et al., J Biol Chem 265: 22075-8 (1990); Wise R et al., Proc Natl Acad Sci USA 87: 9378-82 (1990); Molloy S et al., J Biol Chem 267: 16396-402 (1992)). Consistent with this, many furin inhibitors comprise peptides comprising the motif R-x-x-R. An example of a synthetic inhibitor of furin is a molecule comprising the peptide R-V-K-R (Henrich S et al., Nat Struct Biol 10: 520-6 (2003)). In general, a peptide or protein comprising a surface accessible, dibasic amino acid motif with two positively charged, amino acids separated by two amino acid residues may be predicted to be sensitive to furin-cleavage with cleavage occurring at the carboxy bond of the last basic amino acid in the motif.

Consensus motifs in substrates cleaved by furin have been identified with some degree of specificity. A furin-cleavage site motif has been described that comprises a region of twenty, continuous, amino acid residues, which can be labeled P14 through P6' (Tian S et al., Int J Mol Sci 12: 1060-5 (2011)) using the nomenclature described in Schechter I, Berger, A, Biochem Biophys Res Commun 32: 898-902 (1968). According to this nomenclature, the furin-cleavage site is at the carboxy bond of the amino acid residue designated P1, and the amino acid residues of the furin-cleavage motif are numbered P2, P3, P4, etc., in the direction going toward the amino-terminus from this reference P1 residue. The amino acid residues of the motif going toward the carboxy-terminus from the P1 reference residue are numbered with the prime notation P2', P3', P4', etc. Using this nomenclature, the P6 to P2' region delineates the core substrate of the furin cleavage motif which is bound by the enzymatic domain of furin. The two flanking regions P14 to P7 and P3' to P6' are often rich in polar, amino acid residues to increase the accessibility to the core furin cleavage site located between them.

A general, furin-cleavage site is often described by the consensus motif R-x-x-R which corresponds to P4-P3-P2-P1; where "R" represents an arginine residue (see Table A, supra), a dash "-" represents a peptide bond, and a lowercase "x" represents any amino acid residue. However, other residues and positions may help to further define furin-cleavage motifs. A slightly more refined furin-cleavage site, consensus motif is often reported as the consensus motif R-x-[K/R]-R (where a forward slash "/" means "or" and divides alternative amino acid residues at the same position), which corresponds to P4-P3-P2-P1, because it was observed that furin has a strong preference for cleaving substrates containing this motif.

In addition to the minimal, furin-cleavage site R-x-x-R, a larger, furin-cleavage motif has been described with certain amino acid residue preferences at certain positions. By comparing various known furin substrates, certain physico-chemical properties have been characterized for the amino acids residues in a 20 amino acid residue long, furin-cleavage site motif. The P6 to P2' region of the furin-cleavage motif delineates the core furin-cleavage site which physically interacts with the enzymatic domain of furin. The two flanking regions P14 to P7 and P3' to P6' are often hydrophilic being rich in polar, amino acid residues to increase the surface accessibility of the core furin-cleavage site located between them.

In general, the furin-cleavage motif region from position P5 to P1 tends to comprise amino acid residues with a positive charge and/or high isoelectric points. In particular, the P1 position, which marks the position of furin proteolysis, is generally occupied by an arginine but other positively charged, amino acid residues may occur in this position. Positions P2 and P3 tend to be occupied by flexible, amino acid residues, and in particular P2 tends to be occupied by arginine, lysine, or sometimes by very small and flexible amino acid residues like glycine. The P4 position tends to be occupied by positively charged, amino acid residues in furin substrates. However, if the P4 position is occupied by an aliphatic, amino acid residue, then the lack of a positively charged, functional group can be compensated for by a positively charged residue located at position(s) P5 and/or P6. Positions P1' and P2' are commonly occupied by aliphatic and/or hydrophobic amino acid residues, with the P1' position most commonly being occupied by a serine.

The two, hydrophilic, flanking regions tend to be occupied by amino acid residues which are polar, hydrophilic, and have smaller amino acid functional groups; however, in certain verified furin substrates, the flanking regions do not contain any hydrophilic, amino acid residues (see Tian S, *Biochem Insights* 2: 9-20 (2009)).

The twenty amino acid residue, furin-cleavage motif and furin-cleavage site found in native, Shiga toxin A Subunits at the junction between the Shiga toxin A1 fragment and A2 fragment is well characterized in certain Shiga toxins. For example in StxA (SEQ ID NO:2) and SLT-1A (SEQ ID NO:1), this furin-cleavage motif is natively positioned from L238 to F257, and in SLT-2A (SEQ ID NO:3), this furin-cleavage motif is natively positioned from V237 to Q256. Based on amino acid homology, experiment, and/or furin-cleavage assays described herein, the skilled worker can identify furin-cleavage motifs in other native, Shiga toxin A Subunits or Shiga toxin effector polypeptides, where the motifs are actual furin-cleavage motifs or are predicted to result in the production of A1 and A2 fragments after furin cleavage of those molecules within a eukaryotic cell.

In certain embodiments, the Shiga toxin effector polypeptide of the present invention comprises (1) a Shiga toxin A1 fragment derived polypeptide having a carboxy-terminus and (2) a disrupted furin-cleavage motif at the carboxy-terminus of the Shiga toxin A1 fragment derived polypeptide. The carboxy-terminus of a Shiga toxin A1 fragment derived polypeptide may be identified by the skilled worker by using techniques known in the art, such as, e.g., by using protein sequence alignment software to identify (i) a furin-cleavage motif conserved with a naturally occurring Shiga toxin, (ii) a surface exposed, extended loop conserved with a naturally occurring Shiga toxin, and/or (iii) a stretch of amino acid residues which are predominantly hydrophobic (i.e. a hydrophobic "patch") that may be recognized by the ERAD system.

A protease-cleavage resistant, Shiga toxin effector polypeptide of the present invention (1) may be completely lacking any furin-cleavage motif at a carboxy-terminus of its Shiga toxin A1 fragment region and/or (2) comprise a disrupted furin-cleavage motif at the carboxy-terminus of its Shiga toxin A1 fragment region and/or region derived from the carboxy-terminus of a Shiga toxin A1 fragment. A disruption of a furin-cleavage motif includes various alterations to an amino acid residue in the furin-cleavage motif, such as, e.g., a post-translation modification(s), an alteration of one or more atoms in an amino acid functional group, the addition of one or more atoms to an amino acid functional group, the association to a non-proteinaceous moiety(ies), and/or the linkage to an amino acid residue, peptide, polypeptide such as resulting in a branched proteinaceous structure Protease-cleavage resistant, Shiga toxin effector polypeptides may be created from a Shiga toxin effector polypeptide and/or Shiga toxin A Subunit polypeptide, whether naturally occurring or not, using a method described herein, described in WO 2015/191764 and WO 2016/196344, and/or known to the skilled worker, wherein the resulting molecule still retains one or more Shiga toxin A Subunit functions.

For purposes of the present invention with regard to a furin-cleavage site or furin-cleavage motif, the term "disruption" or "disrupted" refers to an alteration from the naturally occurring furin-cleavage site and/or furin-cleavage motif, such as, e.g., a mutation, that results in a reduction in furin-cleavage proximal to the carboxy-terminus of a Shiga toxin A1 fragment region, or identifiable region derived thereof, as compared to the furin-cleavage of a wild-type Shiga toxin A Subunit or a polypeptide derived from a wild-type Shiga toxin A Subunit comprising only wild-type polypeptide sequences. An alteration to an amino acid residue in the furin-cleavage motif includes a mutation in the furin-cleavage motif, such as, e.g., a deletion, insertion, inversion, substitution, and/or carboxy-terminal truncation of the furin-cleavage motif, as well as a post-translation modification, such as, e.g., as a result of glycosylation, albumination, and the like which involve conjugating or linking a molecule to the functional group of an amino acid residue. Because the furin-cleavage motif is comprised of about twenty, amino acid residues, in theory, alterations, modifications, mutations, deletions, insertions, and/or truncations involving one or more amino acid residues of any one of these twenty positions might result in a reduction of furin-cleavage sensitivity (Tian S et al., *Sci Rep* 2: 261 (2012)). The disruption of a furin-cleavage site and/or furin-cleavage motif may or may not increase resistance to cleavage by other proteases, such as, e.g., trypsin and extracellular proteases common in the vascular system of mammals. The effects of a given disruption to cleavage sensitivity of a given protease may be tested by the skilled worker using techniques known in the art.

For purposes of the present invention, a "disrupted furin-cleavage motif" is furin-cleavage motif comprising an alteration to one or more amino acid residues derived from the 20 amino acid residue region representing a conserved, furin-cleavage motif found in native, Shiga toxin A Subunits at the junction between the Shiga toxin A1 fragment and A2 fragment regions and positioned such that furin cleavage of a Shiga toxin A Subunit results in the production of the A1 and A2 fragments; wherein the disrupted furin-cleavage motif exhibits reduced furin cleavage in an experimentally reproducible way as compared to a reference molecule comprising a wild-type, Shiga toxin A1 fragment region fused to a carboxy-terminal polypeptide of a size large enough to monitor furin cleavage using the appropriate assay known to the skilled worker and/or described herein.

Examples of types of mutations which can disrupt a furin-cleavage site and furin-cleavage motif are amino acid residue deletions, insertions, truncations, inversions, and/or substitutions, including substitutions with non-standard amino acids and/or non-natural amino acids. In addition, furin-cleavage sites and furin-cleavage motifs can be disrupted by mutations comprising the modification of an amino acid by the addition of a covalently-linked structure which masks at least one amino acid in the site or motif, such as, e.g., as a result of PEGylation, the coupling of small molecule adjuvants, and/or site-specific albumination.

If a furin-cleavage motif has been disrupted by mutation and/or the presence of non-natural amino acid residues, certain disrupted furin-cleavage motifs may not be easily recognizable as being related to any furin-cleavage motif; however, the carboxy-terminus of the Shiga toxin A1 fragment derived region will be recognizable and will define where the furin-cleavage motif would be located were it not disrupted. For example, a disrupted furin-cleavage motif may comprise less than the twenty, amino acid residues of the furin-cleavage motif due to a carboxy-terminal truncation as compared to a Shiga toxin A Subunit and/or Shiga toxin A1 fragment.

In certain embodiments, the Shiga toxin effector polypeptide of the present invention comprises (1) a Shiga toxin A1 fragment derived polypeptide having a carboxy-terminus and (2) a disrupted furin-cleavage motif at the carboxy-terminus of the Shiga toxin A1 fragment polypeptide region; wherein the Shiga toxin effector polypeptide (and any cell-targeting molecule comprising it) is more furin-cleavage resistant as compared to a reference molecule, such as, e.g., a wild-type Shiga toxin polypeptide comprising the carboxy-terminus of an A1 fragment and/or the conserved, furin-cleavage motif between A1 and A2 fragments. For example, a reduction in furin cleavage of one molecule compared to a reference molecule may be determined using an in vitro, furin-cleavage assay described in the Examples below, conducted using the same conditions, and then performing a quantitation of the band density of any fragments resulting from cleavage to quantitatively measure in change in furin cleavage.

In certain embodiments, the Shiga toxin effector polypeptide is more resistant to furin-cleavage in vitro and/or in vivo as compared to a wild-type, Shiga toxin A Subunit.

In general, the protease-cleavage sensitivity of a cell-targeting molecule of the present invention is tested by comparing it to the same molecule having its furin-cleavage resistant, Shiga toxin effector polypeptide replaced with a wild-type, Shiga toxin effector polypeptide comprising a Shiga toxin A1 fragment. In certain embodiments, the molecules of the present invention comprising a disrupted furin-cleavage motif exhibits a reduction in in vitro furin cleavage of 30%, 40%, 50%, 60%, 70%, 80%, 90%, 95%, 97%, 98% or greater compared to a reference molecule comprising a wild-type, Shiga toxin A1 fragment fused at its carboxy-terminus to a peptide or polypeptide, such as, e.g., the reference molecule SLT-1A-WT::scFv1::C2 (SEQ ID NO:278) described in the Examples below.

Several furin-cleavage motif disruptions have been described. For example, mutating the two conserved arginines to alanines in the minimal R-x-x-R motif completely blocked processing by furin and/or furin-like proteases (see e.g Duda A et al., *J Virology* 78: 13865-70 (2004)). Because the furin-cleavage site motif is comprised of about twenty amino acid residues, in theory, certain mutations involving one or more of any one of these twenty, amino acid residue positions might abolish furin cleavage or reduce furin cleavage efficiency (see e.g. Tian S et al., *Sci Rep* 2: 261 (2012)).

In certain embodiments, the molecules of the present invention comprise a Shiga toxin effector polypeptide derived from at least one A Subunit of a member of the Shiga toxin family wherein the Shiga toxin effector polypeptide comprises a disruption in one or more amino acids derived from the conserved, highly accessible, protease-cleavage sensitive loop of Shiga toxin A Subunits. For example, in StxA and SLT-1A, this highly accessible, protease-sensitive loop is natively positioned from amino acid residues 242 to 261, and in SLT-2A, this conserved loop is natively positioned from amino acid residues 241 to 260. Based on polypeptide sequence homology, the skilled worker can identify this conserved, highly accessible loop structure in other Shiga toxin A Subunits. Certain mutations to the amino acid residues in this loop can reduce the accessibility of certain amino acid residues within the loop to proteolytic cleavage and this might reduce furin-cleavage sensitivity.

In certain embodiments, a molecule of the present invention comprises a Shiga toxin effector polypeptide comprising a disrupted furin-cleavage motif comprising a mutation in the surface-exposed, protease sensitive loop conserved among Shiga toxin A Subunits. In certain further embodiments, a molecule of the present invention comprises a Shiga toxin effector polypeptide comprising a disrupted furin-cleavage motif comprising a mutation in this protease-sensitive loop of Shiga toxin A Subunits, the mutation which reduce the surface accessibility of certain amino acid residues within the loop such that furin-cleavage sensitivity is reduced.

In certain embodiments, the disrupted furin-cleavage motif of a Shiga toxin effector polypeptide of the present invention comprises a disruption in terms of existence, position, or functional group of one or both of the consensus amino acid residues P1 and P4, such as, e.g., the amino acid residues in positions 1 and 4 of the minimal furin-cleavage motif R/Y-x-x-R. For example, mutating one or both of the two arginine residues in the minimal, furin consensus site R-x-x-R to alanine will disrupt a furin-cleavage motif and prevent furin-cleavage at that site. Similarly, amino acid residue substitutions of one or both of the arginine residues in the minimal furin-cleavage motif R-x-x-R to any non-conservative amino acid residue known to the skilled worker will reduced the furin-cleavage sensitivity of the motif. In particular, amino acid residue substitutions of arginine to any non-basic amino acid residue which lacks a positive charge, such as, e.g., A, G, P, S, T, D, E, Q, N, C, I, L, M, V, F, W, and Y, will result in a disrupted furin-cleavage motif.

In certain embodiments, the disrupted furin-cleavage motif of a Shiga toxin effector polypeptide of the present invention comprises a disruption in the spacing between the consensus amino acid residues P4 and P1 in terms of the number of intervening amino acid residues being other than two, and, thus, changing either P4 and/or P1 into a different position and eliminating the P4 and/or P1 designations. For example, deletions within the furin-cleavage motif of the minimal furin-cleavage site or the core, furin-cleavage motif will reduce the furin-cleavage sensitivity of the furin-cleavage motif.

In certain embodiments, the disrupted furin-cleavage motif comprises one or more amino acid residue substitutions, as compared to a wild-type, Shiga toxin A Subunit. In certain further embodiments, the disrupted furin-cleavage motif comprises one or more amino acid residue substitutions within the minimal furin-cleavage site R/Y-x-x-R, such as, e.g., for StxA and SLT-1A derived Shiga toxin effector polypeptides, the natively positioned amino acid residue R248 substituted with any non-positively charged, amino acid residue and/or R251 substituted with any non-positively charged, amino acid residue; and for SLT-2A derived Shiga toxin effector polypeptides, the natively positioned amino acid residue Y247 substituted with any non-positively charged, amino acid residue and/or R250 substituted with any non-positively charged, amino acid residue.

In certain embodiments, the disrupted furin-cleavage motif comprises an un-disrupted, minimal furin-cleavage site R/Y-x-x-R but instead comprises a disrupted flanking region, such as, e.g., amino acid residue substitutions in one or more amino acid residues in the furin-cleavage motif flanking regions natively position at, e.g., 241-247 and/or 252-259. In certain further embodiments, the disrupted furin cleavage motif comprises a substitution of one or more of the amino acid residues located in the P1-P6 region of the furin-cleavage motif; mutating P1' to a bulky amino acid, such as, e.g., R, W, Y, F, and H; and mutating P2' to a polar and hydrophilic amino acid residue; and substituting one or more of the amino acid residues located in the P1'-P6' region of the furin-cleavage motif with one or more bulky and hydrophobic amino acid residues In certain embodiments, the disruption of the furin-cleavage motif comprises a deletion, insertion, inversion, and/or mutation of at least one amino acid residue within the furin-cleavage motif. In certain embodiments, a protease-cleavage resistant, Shiga toxin effector polypeptide of the present invention may comprise a disruption of the amino acid sequence natively positioned at 248-251 of the A Subunit of Shiga toxin (SEQ ID NOs: 1-2 and 4-6), at 247-250 of the A Subunit of Shiga-like toxin 2 (SEQ ID NOs: 3 and 7-18), or at the equivalent position in a conserved Shiga toxin effector polypeptide and/or non-native Shiga toxin effector polypeptide sequence. In certain further embodiments, protease-cleavage resistant, Shiga toxin effector polypeptides comprise a disruption which comprises a deletion of at least one amino acid within the furin-cleavage motif. In certain further embodiments, protease-cleavage resistant, Shiga toxin effector polypeptides comprise a disruption which comprises an insertion of at least one amino acid within the protease-cleavage motif region. In certain further embodiments, the protease-cleavage resistant, Shiga toxin effector polypeptides comprise a disruption which comprises an inversion of amino acids, wherein at least one inverted amino acid is within the protease motif region. In certain further embodiments, the protease-cleavage resistant, Shiga toxin effector polypeptides comprise a disruption which comprises a mutation, such as an amino acid substitution to a non-standard amino acid or an amino acid with a chemically modified side chain. Examples of single amino acid substitutions are provided in the Examples below.

In certain embodiments of the molecules of the present invention, the disrupted furin-cleavage motif comprises the deletion of nine, ten, eleven, or more of the carboxy-terminal amino acid residues within the furin-cleavage motif. In these embodiments, the disrupted furin-cleavage motif will not comprise a furin-cleavage site or a minimal furin-cleavage motif. In other words, certain embodiments lack a furin-cleavage site at the carboxy-terminus of the A1 fragment region.

In certain embodiments, the disrupted furin-cleavage motif comprises both an amino acid residue deletion and an amino acid residue substitution as compared to a wild-type, Shiga toxin A Subunit. In certain further embodiments, the disrupted furin-cleavage motif comprises one or more amino acid residue deletions and substitutions within the minimal furin-cleavage site R/Y-x-x-R, such as, e.g., for StxA and SLT-1A derived Shiga toxin effector polypeptides, the natively positioned amino acid residue R248 substituted with any non-positively charged, amino acid residue and/or R251 substituted with any non-positively charged, amino acid residue; and for SLT-2A derived Shiga toxin effector polypeptides, the natively positioned amino acid residue Y247 substituted with any non-positively charged, amino acid residue and/or R250 substituted with any non-positively charged, amino acid residue.

In certain embodiments, the disrupted furin-cleavage motif comprises an amino acid residue deletion and an amino acid residue substitution as well as a carboxy-terminal truncation as compared to a wild-type, Shiga toxin A Subunit. In certain further embodiments, the disrupted furin-cleavage motif comprises one or more amino acid residue deletions and substitutions within the minimal furin-cleavage site R/Y-x-x-R, such as, e.g., for StxA and SLT-1A derived Shiga toxin effector polypeptides, the natively positioned amino acid residue R248 substituted with any non-positively charged, amino acid residue and/or R251 substituted with any non-positively charged, amino acid residue; and for SLT-2A derived Shiga toxin effector polypeptides, the natively positioned amino acid residue Y247 substituted with any non-positively charged, amino acid residue and/or R250 substituted with any non-positively charged, amino acid residue.

In certain further embodiments, the disrupted furin-cleavage motif comprises both an amino acid substitution within the minimal furin-cleavage site R/Y-x-x-R and a carboxy-terminal truncation as compared to a wild-type, Shiga toxin A Subunit, such as, e.g., for StxA and SLT-1A derived Shiga toxin effector polypeptides, truncations ending at the natively amino acid position 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, or greater and comprising the natively positioned amino acid residue R248 and/or R251 substituted with any non-positively charged, amino acid residue where appropriate; and for SLT-2A derived Shiga toxin effector polypeptides, truncations ending at the natively amino acid position 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, or greater and comprising the natively positioned amino acid residue Y247 and/or R250 substituted with any non-positively charged, amino acid residue where appropriate.

In certain embodiments, the disrupted furin-cleavage motif comprises an insertion of one or more amino acid residues as compared to a wild-type, Shiga toxin A Subunit as long as the inserted amino residue(s) does not create a de novo furin-cleavage site. In certain embodiments, the insertion of one or more amino acid residues disrupts the natural spacing between the arginine residues in the minimal, furin-cleavage site R/Y-x-x-R, such as, e.g., StxA and SLT-1A derived polypeptides comprising an insertion of one or more amino acid residues at 249 or 250 and thus between R248 and R251; or SLT-2A derived polypeptides comprising an insertion of one or more amino acid residues at 248 or 249 and thus between Y247 and R250.

In certain embodiments, the disrupted furin-cleavage motif comprises both an amino acid residue insertion and a carboxy-terminal truncation as compared to a wild-type, Shiga toxin A Subunit. In certain embodiments, the disrupted furin-cleavage motif comprises both an amino acid residue insertion and an amino acid residue substitution as compared to a wild-type, Shiga toxin A Subunit. In certain embodiments, the disrupted furin-cleavage motif comprises both an amino acid residue insertion and an amino acid residue deletion as compared to a wild-type, Shiga toxin A Subunit.

In certain embodiments, the disrupted furin-cleavage motif comprises an amino acid residue deletion, an amino acid residue insertion, and an amino acid residue substitution as compared to a wild-type, Shiga toxin A Subunit.

In certain embodiments, the disrupted furin-cleavage motif comprises an amino acid residue deletion, insertion, substitution, and carboxy-terminal truncation as compared to a wild-type, Shiga toxin A Subunit.

In certain embodiments, the Shiga toxin effector polypeptide comprising a disrupted furin-cleavage motif is directly fused by a peptide bond to a molecular moiety comprising an amino acid, peptide, and/or polypeptide wherein the fused structure involves a single, continuous polypeptide. In these fusion embodiments, the amino acid sequence following the disrupted furin-cleavage motif should not create a de novo, furin-cleavage site at the fusion junction.

Any of the above protease-cleavage resistant, Shiga toxin effector polypeptide disrupted furin-cleavage motifs may be used alone or in combination with each individual embodiment of the present invention, including methods of the present invention.

3. T-Cell Hyper-Immunized, Shiga Toxin A Subunit Effector Polypeptides

In certain embodiments, the Shiga toxin effector polypeptide of the present invention comprises an embedded or inserted epitope-peptide. In certain further embodiments, the epitope-peptide is a heterologous, T-cell epitope-peptide, such as, e.g., an epitope considered heterologous to Shiga toxin A Subunits. In certain further embodiments, the epitope-peptide is a CD8+ T-cell epitope. In certain further embodiments, the CD8+ T-cell epitope-peptide has a binding affinity to a MHC class I molecule characterized by a dissociation constant ($K_D$) of $10^{-4}$ molar or less and/or the resulting MHC class I-epitope-peptide complex has a binding affinity to a T-cell receptor (TCR) characterized by a dissociation constant ($K_D$) of $10^{-4}$ molar or less.

In certain embodiments, the Shiga toxin effector polypeptide of the present invention comprises an embedded or inserted, heterologous, T-cell epitope, such as, e.g., a human CD8+ T-cell epitope. In certain further embodiments, the heterologous, T-cell epitope is embedded or inserted so as to disrupt an endogenous epitope or epitope region (e.g. a B-cell epitope and/or CD4+ T-cell epitope) identifiable in a naturally occurring Shiga toxin polypeptide or parental Shiga toxin effector polypeptide from which the Shiga toxin effector polypeptide of the present invention is derived.

For certain embodiments of the present invention, the Shiga toxin effector polypeptide (and any cell-targeting molecule comprising it) is CD8+ T-cell hyper-immunized, such as, e.g., as compared to a wild-type Shiga toxin polypeptide. The CD8+ T-cell hyper-immunized, Shiga toxin effector polypeptides of the present invention each comprise a T-cell epitope-peptide. Hyper-immunized, Shiga toxin effector polypeptides can be created from Shiga toxin effector polypeptides and/or Shiga toxin A Subunit polypeptides, whether naturally occurring or not, using a method described herein, described in WO 2015/113007, and/or known to the skilled worker, wherein the resulting molecule still retains one or more Shiga toxin A Subunit functions.

For purposes of the claimed invention, a T-cell epitope is a molecular structure which is comprised by an antigenic peptide and can be represented by a linear, amino acid sequence. Commonly, T-cell epitopes are peptides of sizes of eight to eleven amino acid residues (Townsend A, Bodmer H, *Annu Rev Immunol* 7: 601-24 (1989)); however, certain T-cell epitope-peptides have lengths that are smaller than eight or larger than eleven amino acids long (see e.g. Livingstone A, Fathman C, *Annu Rev Immunol* 5: 477-501 (1987); Green K et al., *Eur J Immunol* 34: 2510-9 (2004)). In certain embodiments, the embedded or inserted epitope is at least seven amino acid residues in length. In certain embodiments, the embedded or inserted epitope is bound by a TCR with a binding affinity characterized by a $K_D$ less than 10 mM (e.g. 1-100 pM) as calculated using the formula in Stone J et al., *Immunology* 126: 165-76 (2009). However, it should be noted that the binding affinity within a given range between the MHC-epitope and TCR may not correlate with antigenicity and/or immunogenicity (see e.g. A1-Ramadi B et al., *J Immunol* 155: 662-73 (1995)), such as due to factors like MHC-peptide-TCR complex stability, MHC-peptide density and MHC-independent functions of TCR cofactors such as CD8 (Valitutti S et al., *J Exp Med* 183: 1917-21 (1996); Baker B et al., *Immunity* 13: 475-84 (2000); Hornell T et al., *J Immunol* 170: 4506-14 (2003); Faroudi M et al., *Proc Natl Acad Sci USA* 100: 14145-50 (2003); Woolridge L et al., *J Immunol* 171: 6650-60 (2003); Purbhoo M et al., *Nat Immunol* 5: 524-30 (2004)).

A heterologous, T-cell epitope is an epitope not already present in a wild-type Shiga toxin A Subunit; a naturally occurring Shiga toxin A Subunit; and/or a parental, Shiga toxin effector polypeptide used as a source polypeptide for modification by a method described herein, described in WO 2015/113007 and/or WO 2016/196344, and/or known to the skilled worker.

A heterologous, T-cell epitope-peptide may be incorporated into a source polypeptide via numerous methods known to the skilled worker, including, e.g., the processes of creating one or more amino acid substitutions within the source polypeptide, fusing one or more amino acids to the source polypeptide, inserting one or more amino acids into the source polypeptide, linking a peptide to the source polypeptide, and/or a combination of the aforementioned processes. The result of such a method is the creation of a modified variant of the source polypeptide which comprises one or more embedded or inserted, heterologous, T-cell epitope-peptides.

T-cell epitopes may be chosen or derived from a number of source molecules for use in the present invention. T-cell epitopes may be created or derived from various naturally occurring proteins. T-cell epitopes may be created or derived from various naturally occurring proteins foreign to mammals, such as, e.g., proteins of microorganisms. T-cell epitopes may be created or derived from mutated human proteins and/or human proteins aberrantly expressed by malignant human cells. T-cell epitopes may be synthetically created or derived from synthetic molecules (see e.g., Carbone F et al., *J Exp Med* 167: 1767-9 (1988); Del Val M et al., *J Virol* 65: 3641-6 (1991); Appella E et al., *Biomed Pept Proteins Nucleic Acids* 1: 177-84 (1995); Perez S et al., *Cancer* 116: 2071-80 (2010)).

Although any T-cell epitope-peptide is contemplated as being used as a heterologous, T-cell epitope of the present invention, certain epitopes may be selected based on desirable properties. One objective of the present invention is to create CD8+ T-cell hyper-immunized, Shiga toxin effector polypeptides for administration to vertebrates, meaning that the heterologous, T-cell epitope is highly immunogenic and can elicit robust immune responses in vivo when displayed complexed with a MHC class I molecule on the surface of a cell. In certain embodiments, the Shiga toxin effector polypeptide of the present invention comprises one or more, embedded or inserted, heterologous, T-cell epitopes which are CD8+ T-cell epitopes. A Shiga toxin effector polypeptide of the present invention that comprises a heterologous, CD8+ T-cell epitope is considered a CD8+ T-cell hyper-immunized, Shiga toxin effector polypeptide.

T-cell epitope components of the present invention may be chosen or derived from a number of source molecules already known to be capable of eliciting a vertebrate immune response. T-cell epitopes may be derived from various naturally occurring proteins foreign to vertebrates, such as, e.g., proteins of pathogenic microorganisms and non-self, cancer antigens. In particular, infectious microorganisms may contain numerous proteins with known antigenic and/or immunogenic properties. Further, infectious microorganisms may contain numerous proteins with known antigenic and/or immunogenic sub-regions or epitopes.

For example, the proteins of intracellular pathogens with mammalian hosts are sources for T-cell epitopes. There are numerous intracellular pathogens, such as viruses, bacteria, fungi, and single-cell eukaryotes, with well-studied antigenic proteins or peptides. T-cell epitopes can be selected or identified from human viruses or other intracellular pathogens, such as, e.g., bacteria like mycobacterium, fungi like toxoplasmae, and protists like trypanosomes.

For example, there are many immunogenic, viral peptide components of viral proteins from viruses that are infectious to humans. Numerous, human T-cell epitopes have been mapped to peptides within proteins from influenza A viruses, such as peptides in the proteins HA glycoproteins FE17, S139/1, CH65, C05, hemagglutin 1 (HA1), hemagglutinin 2 (HA2), nonstructural protein 1 and 2 (NS1 and NS 2), matrix protein 1 and 2 (M1 and M2), nucleoprotein (NP), neuraminidase (NA)), and many of these peptides have been shown to elicit human immune responses, such as by using ex vivo assay. Similarly, numerous, human T-cell epitopes have been mapped to peptide components of proteins from human cytomegaloviruses (HCMV), such as peptides in the proteins pp65 (UL83), UL128-131, immediate-early 1 (IE-1; UL123), glycoprotein B, tegument proteins, and many of these peptides have been shown to elicit human immune responses, such as by using ex vivo assays.

Another example is there are many immunogenic, cancer antigens in humans. The CD8+ T-cell epitopes of cancer and/or tumor cell antigens can be identified by the skilled worker using techniques known in the art, such as, e.g., differential genomics, differential proteomics, immunoproteomics, prediction then validation, and genetic approaches like reverse-genetic transfection (see e.g., Admon A et al., *Mol Cell Proteomics* 2: 388-98 (2003); Purcell A, Gorman J, *Mol Cell Proleomics* 3: 193-208 (2004); Comber J, Philip R, *Ther Adv Vaccines* 2: 77-89 (2014)). There are many antigenic and/or immunogenic T-cell epitopes already identified or predicted to occur in human cancer and/or tumor cells. For example, T-cell epitopes have been predicted in human proteins commonly mutated or overexpressed in neoplastic cells, such as, e.g., ALK, CEA, N-acetylglucosaminyl-transferase V (GnT-V), HCA587, HER-2/neu, MAGE, Melan-A/MART-1, MUC-1, p53, and TRAG-3 (see e.g., van der Bruggen P et al., *Science* 254: 1643-7 (1991); Kawakami Y et al., *J Exp Med* 180: 347-52 (1994); Fisk B et al., *J Exp Med* 181: 2109-17 (1995); Guilloux Y et al., *J Exp Med* 183: 1173 (1996); Skipper J et al., *J Exp Med* 183: 527 (1996); Brossart P et al., 93: 4309-17 (1999); Kawashima I et al., *Cancer Res* 59: 431-5 (1999); Papadopoulos K et al., *Clin Cancer Res* 5: 2089-93 (1999); Zhu B et al., *Clin Cancer Res* 9: 1850-7 (2003); Li B et al., *Clin Exp Immunol* 140: 310-9 (2005); Ait-Tahar K et al., *Int J Cancer* 118: 688-95 (2006); Akiyama Y et al., *Cancer Immunol Immunother* 61: 2311-9 (2012)). In addition, synthetic variants of T-cell epitopes from human cancer cells have been created (see e.g., Lazoura E, Apostolopoulos V, *Curr med Chem* 12: 629-39 (2005); Douat-Casassus C et al., *J Med Chem* 50: 1598-609 (2007)).

While any T-cell epitope may be used in the polypeptides and molecules of the present invention, certain T-cell epitopes may be preferred based on their known and/or empirically determined characteristics. For example, in many species, the MHC alleles in its genome encode multiple MHC-I molecular variants. Because MHC class I protein polymorphisms can affect antigen-MHC class I complex recognition by CD8+ T-cells, T-cell epitopes may be chosen for use in the present invention based on knowledge about certain MHC class I polymorphisms and/or the ability of certain antigen-MHC class I complexes to be recognized by T-cells having different genotypes.

There are well-defined peptide-epitopes that are known to be immunogenic, MHC class I restricted, and/or matched with a specific human leukocyte antigen (HLA) variant(s). For applications in humans or involving human target cells, HLA-class I-restricted epitopes can be selected or identified by the skilled worker using standard techniques known in the art. The ability of peptides to bind to human MHC class I molecules can be used to predict the immunogenic potential of putative T-cell epitopes. The ability of peptides to bind to human MHC class I molecules can be scored using software tools. T-cell epitopes may be chosen for use as a heterologous, T-cell epitope component of the present invention based on the peptide selectivity of the HLA variants encoded by the alleles more prevalent in certain human populations. For example, the human population is polymorphic for the alpha chain of MHC class I molecules due to the varied alleles of the HLA genes from individual to individual. In certain T-cell epitopes may be more efficiently presented by a specific HLA molecule, such as, e.g., the commonly occurring HLA variants encoded by the HLA-A allele groups HLA-A2 and HLA-A3.

When choosing T-cell epitopes for use as a heterologous, T-cell epitope component of the present invention, multiple factors may be considered that can influence epitope generation and transport to receptive MHC class I molecules, such as, e.g., the presence and epitope specificity of the following factors in the target cell: proteasome, ERAAP/ERAP1, tapasin, and TAPs.

When choosing T-cell epitopes for use as a heterologous, T-cell epitope component of the present invention, epitope may be selected which best match the MHC class I molecules present in the cell-type or cell populations to be targeted. Different MHC class I molecules exhibit preferential binding to particular peptide sequences, and particular peptide-MHC class I variant complexes are specifically recognized by the T-cell receptors (TCRs) of effector T-cells. The skilled worker can use knowledge about MHC class I molecule specificities and TCR specificities to optimize the selection of heterologous, T-cell epitopes used in the present invention.

In addition, multiple, immunogenic, T-cell epitopes for MHC class I presentation may be embedded in the same Shiga toxin effector polypeptide of the present invention, such as, e.g., for use in the targeted delivery of a plurality of T-cell epitopes simultaneously. An example of a cell-targeting molecule of the present invention comprising multiple, CD8+ T-cell epitopes is SEQ ID NO:253.

4. Site-Specific Conjugation Sites in Shiga Toxin Effector Polypeptides

In certain embodiments of the molecules of the present invention, the Shiga toxin effector polypeptide comprises a unique amino acid residue, such as, e.g., a cysteine, lysine, selenocysteine, or pyrroline-carboxy-lysine residue, which may optionally be linked, either directly or indirectly, to an agent or cargo for targeted delivery, including, e.g., a cell-targeting molecule altering agent which confers a desirable property to a cell-targeting molecule comprising the Shiga toxin effector polypeptide upon administration to a mammal (see e.g. PCT/US2017/065074). Molecules comprising such Shiga toxin effector polypeptides may be equipped with a site-specific position, such as, e.g., a unique amino acid residue in the molecule, for linking other molecules while retaining Shiga toxin function(s), such as, e.g., stimulating cellular internalization, directing efficient intracellular routing, and/or potent cytotoxicity. In certain further embodiments, the Shiga toxin effector polypeptide is conjugated to another moiety, agent, and/or cargo, either directly or indirectly, via the unique amino acid residue, such as, e.g., via the functional group of the unique amino acid (see e.g. PCT/US2017/065074).

B. Heterologous, CD8+ T-Cell Epitope-Peptide Cargos for Delivery

The cell-targeting molecules of the present invention each comprise one or more CD8+ T-cell epitope-peptides that are heterologous to their respective Shiga toxin effector polypeptide(s) and binding region(s) and which are not embedded or inserted within a Shiga toxin effector polypeptide component.

For purposes of the claimed invention, a CD8+ T-cell epitope (also known as a MHC class I epitope or MHC class I peptide) is a molecular structure which is comprised by an antigenic peptide and can be represented by a linear, amino acid sequence. Commonly, CD8+ T-cell epitopes are peptides of sizes of eight to eleven amino acid residues (Townsend A, Bodmer H, Annu Rev Immunol 7: 601-24 (1989)); however, certain CD8+ T-cell epitopes have lengths that are smaller than eight or larger than eleven amino acids long (see e.g. Livingstone A, Fathman C, Annu Rev Immunol 5: 477-501 (1987); Green K et al., Eur. J Immunol 34: 2510-9 (2004)).

A CD8+ T-cell epitope is a molecular structure recognizable by an immune system of at least one individual, i.e. an antigenic peptide. The heterologous, CD8+ T-cell epitope-peptide cargo of the cell-targeting molecule of the present invention can be chosen from virtually any CD8+ T-cell epitope. In certain embodiments, the heterologous, CD8+ T-cell epitope-peptide cargo has a binding affinity to a MHC class I molecule characterized by a dissociation constant ($K_D$) of $10^{-4}$ molar or less and/or the resulting MHC class I-epitope-peptide complex has a binding affinity to a T-cell receptor (TCR) characterized by a dissociation constant ($K_D$) of $10^{-4}$ molar or less.

T-cell epitopes can be empirical characterized by a binding affinity, as described above. The critical structural elements of a T-cell epitope can be identified and further analyzed using assays known to the skilled worker, such as, e.g., a combination of alanine scanning mutagenesis and binding affinity experiments, which may also take crystallographic or other empirical structural data into account. In some instances, the energetic contributions of some or all of the amino acid residues in the epitope-peptide to the epitope-MHC complex and/or epitope-MHC-TCR complex may be estimated or calculated. Certain residues/positions may be considered or categorized as either determinant for binding affinity or neutral. Furthermore, determinant residues/positions/structures can be further categorized as contact-determining, specificity-determining, and/or affinity determining (see e.g. Langman R, Mol Immunol 37: 555-61 (2000); Greenspan N, Adv Cancer Res 80: 147-87 (2001); Cohn M, Mol Immunol 42: 651-5 (2005)). Certain CD8+ T-cell epitopes may be represented by a consensus amino acid sequence, which allows for some variation in amino acid identity and/or positioning.

In certain embodiments of the present invention, the heterologous, CD8+ T-cell epitope-peptide is at least seven amino acid residues in length. In certain embodiments of the present invention, the CD8+ T-cell epitope-peptide is bound by a TCR with a binding affinity characterized by a $K_D$ less than 10 millimolar (mM) (e.g. 1-100 pM) as calculated using the formula in Stone J et al., Immunology 126: 165-76 (2009). However, it should be noted that the binding affinity within a given range between the MHC-epitope and TCR may not correlate with antigenicity and/or immunogenicity (see e.g. Al-Ramadi B et al., J Immunol 155: 662-73 (1995)), such as due to factors like MHC I-peptide-TCR complex stability, MHC I-peptide density and MHC-independent functions of TCR cofactors such as CD8 (Baker B et al., Immunity 13: 475-84 (2000); Hornell T et al., J Immunol 170: 4506-14 (2003); Woolridge L et al., J Immunol 171: 6650-60 (2003)).

T-cell epitopes may be chosen or derived from a number of source molecules for use in the present invention. T-cell epitopes may be created or derived from various naturally occurring proteins. T-cell epitopes may be created or derived from various naturally occurring proteins foreign to mammals, such as, e.g., proteins of microorganisms. T-cell epitopes may be created or derived from mutated human proteins and/or human proteins aberrantly expressed by malignant human cells. T-cell epitopes may be synthetically created or derived from synthetic molecules (see e.g., Carbone F et al., J Exp Med 167: 1767-9 (1988); Del Val M et al., J Virol 65: 3641-6 (1991); Appella E et al., Biomed Pept Proteins Nucleic Acids 1: 177-84 (1995); Perez S et al., Cancer 116: 2071-80 (2010)).

The CD8+ T-cell epitope-peptide of the cell-targeting molecule of the present invention can be chosen from various known antigens, such as, e.g., well-characterized immunogenic epitopes from human pathogens, typically the most common pathogenic viruses and bacteria.

CD8+ T-cell epitopes can be identified by reverse immunology methods known to the skilled worker, such as, e.g., genetic approaches, library screening, and eluting peptides off of cells displaying MHC class I molecules and sequencing them by mass-spectrometry, (see e.g. Van Der Bruggen P et al., Immunol Rev 188: 51-64 (2002)).

Additionally, other MHC I-peptide binding assays based on a measure of the ability of a peptide to stabilize the ternary MHC-peptide complex for a given MHC class I allele, as a comparison to known controls, have been developed (e.g., MHC I-peptide binding assay from ProImmune, Inc., Sarasota, Fla., U.S.). Such approaches can help predict the effectiveness of a putative CD8+ T-cell epitope-peptide or to corroborate empirical evidence regarding a known CD8+ T-cell epitope.

Although any CD8+ T-cell epitope is contemplated as being used as a heterologous, CD8+ T-cell epitope of the present invention, certain CD8+ T-cell epitopes may be selected based on desirable properties. One objective is to create CD8+ T-cell hyper-immunized cell-targeting molecules, meaning that the heterologous, CD8+ T-cell epitope-peptide is highly immunogenic because it can elicit robust immune responses in vivo when displayed complexed with a MHC class I molecule on the surface of a cell.

CD8+ T-cell epitopes may be derived from a number of source molecules already known to be capable of eliciting a vertebrate immune response. CD8+ T-cell epitopes may be derived from various naturally occurring proteins foreign to vertebrates, such as, e.g., proteins of pathogenic microorganisms and non-self, cancer antigens. In particular, infectious microorganisms may contain numerous proteins with known antigenic and/or immunogenic properties. Further, infectious microorganisms may contain numerous proteins with known antigenic and/or immunogenic sub-regions or epitopes. CD8+ T-cell epitopes may be derived from mutated human proteins and/or human proteins aberrantly expressed by malignant human cells, such as, e.g., mutated proteins expressed by cancer cells (see e.g. Sjoblom T et al., Science 314: 268-74 (2006); Wood L et al., Science 318: 1108-13 (2007); Jones S et al., Science 321: 1801-6 (2008); Parsons D et al., Science 321: 1807-12 (2008); Wei X et al., Nat Genet 43: 442-6 (2011); Govindan R et al., Cell 150: 1121-34 (2012); Vogelstein B et al., Science 339: 1546-58 (2013); Boegel S et al., Oncoimmunology 3: e954893 (2014)).

CD8+ T-cell epitopes may be chosen or derived from a number of source molecules already known to be capable of eliciting a mammalian immune response, including peptides, peptide components of proteins, and peptides derived from proteins. For example, the proteins of intracellular pathogens with mammalian hosts are sources for CD8+ T-cell epitopes. There are numerous intracellular pathogens, such as viruses, bacteria, fungi, and single-cell eukaryotes, with well-studied antigenic proteins or peptides. CD8+ T-cell epitopes can be selected or identified from human viruses or other intracellular pathogens, such as, e.g., bacteria like mycobacterium, fungi like toxoplasmae, and protists like trypanosomes.

For example, there are many known immunogenic viral peptide components of viral proteins from viruses that infect humans. Numerous human CD8+ T-cell epitopes have been mapped to peptides within proteins from influenza A viruses, such as peptides in the proteins HA glycoproteins FE17, S139/1, CH65, C05, hemagglutinin 1 (HA1), hemagglutinin 2 (HA2), nonstructural protein 1 and 2 (NS1 and NS 2), matrix protein 1 and 2 (M1 and M2), nucleoprotein (NP), neuraminidase (NA)), and many of these peptides have been shown to elicit human immune responses, such as by using ex vivo assay (see e.g. Assarsson E et al, *J Virol* 82: 12241-51 (2008); Alexander J et al., *Hum Immunol* 71: 468-74 (2010); Wang M et al., *PLoS One* 5: e10533 (2010); Wu J et al., *Clin Infect Dis* 51: 1184-91 (2010); Tan P et al., *Human Vaccin* 7: 402-9 (2011); Grant E et al., *Immunol Cell Biol* 91: 184-94 (2013); Terajima M et al., *Virol J* 10: 244 (2013)). Similarly, numerous human CD8+ T-cell epitopes have been mapped to peptide components of proteins from human cytomegaloviruses (HCMV), such as peptides in the proteins pp65 (UL83), UL128-131, immediate-early 1 (IE-1; UL123), glycoprotein B, tegument proteins, and many of these peptides have been shown to elicit human immune responses, such as by using ex vivo assays (Schoppel K et al., *J Infect Dis* 175: 533-44 (1997); Elkington R et al, *J Virol* 77: 5226-40 (2003); Gibson L et al., *J Immunol* 172: 2256-64 (2004); Ryckman B et al., *J Virol* 82: 60-70 (2008); Sacre K et al., *J Virol* 82: 10143-52 (2008)).

Another example is there are many immunogenic, cancer antigens in humans. The CD8+ T-cell epitopes of cancer and/or tumor cell antigens can be identified by the skilled worker using techniques known in the art, such as, e.g., differential genomics, differential proteomics, immunoproteomics, prediction then validation, and genetic approaches like reverse-genetic transfection (see e.g., Admon A et al., *Mol Cell Proteomics* 2: 388-98 (2003); Purcell A, Gorman J, *Mol Cell Proteomics* 3: 193-208 (2004); Comber J, Philip R, *Ther Adv Vaccines* 2: 77-89 (2014)). There are many antigenic and/or immunogenic T-cell epitopes already identified or predicted to occur in human cancer and/or tumor cells. For example, T-cell epitopes have been predicted in human proteins commonly mutated or overexpressed in neoplastic cells, such as, e.g., ALK, CEA, N-acetylglucosaminyl-transferase V (GnT-V), HCA587, HER-2/neu, MAGE, Melan-A/MART-1, MUC-1, p53, and TRAG-3 (see e.g., van der Bruggen P et al., *Science* 254: 1643-7 (1991); Kawakami Y et al., *J Exp Med* 180: 347-52 (1994); Fisk B et al., *J Exp Med* 181: 2109-17 (1995); Guilloux Y et al., *J Exp Med* 183: 1173 (1996); Skipper J et al., *J Ep Med* 183: 527 (1996); Brossart P et al., 93: 4309-17 (1999); Kawashima I et al., *Cancer Res* 59: 431-5 (1999); Papadopoulos K et al., *Clin Cancer Res* 5: 2089-93 (1999); Zhu B et al., *Clin Cancer Res* 9: 1850-7 (2003); Li B et al., *Clin Exp Immunol* 140: 310-9 (2005); Ait-Tahar K et al., *Int J Cancer* 118: 688-95 (2006); Akiyama Y et al., *Cancer Immunol Immunother* 61: 2311-9 (2012)). In addition, synthetic variants of T-cell epitopes from human cancer cells have been created (see e.g., Lazoura E, Apostolopoulos V, *Curr Med Chem* 12: 629-39 (2005); Douat-Casassus C et al., *J Med Chem* 50: 1598-609 (2007)).

The term "cargo" with respect to a heterologous, CD8+ T-cell epitope is used herein to signify that the heterologous, CD8+ T-cell epitope is not embedded or inserted within a Shiga toxin effector polypeptide's Shiga toxin A1 fragment derived region or is not embedded or inserted within a Shiga toxin effector polypeptide component (see e.g. WO 2015/113005). Thus, a cell-targeting molecule of the present invention may comprise multiple, heterologous, CD8+ T-cell epitopes but only one which is a cargo because the other heterologous, CD8+ T-cell epitopes are embedded or inserted into a Shiga toxin A1 fragment region of a Shiga toxin effector polypeptide component of the cell-targeting molecule.

While any heterologous, CD8+ T-cell epitope may be used in the compositions and methods of the present invention, certain CD8+ T-cell epitopes may be preferred based on their known and/or empirically determined characteristics. Immunogenic peptide-epitopes that elicit a human, CD8+ T-cell responses have been described and/or can be identified using techniques known to the skilled worker (see e.g. Kalish R, *J Invest Dermatol* 94: 108S-111S (1990); Altman J et al., *Science* 274: 94-6 (1996); Callan M et al., *J Exp Med* 187: 1395-402 (1998); Dunbar P et al., *Curr Biol* 8: 413-6 (1998); Sourdive D et al., J Exp Med 188: 71-82 (1998); Collins E et al., *J Immunol* 162: 331-7 (1999); Yee C et al., *J Immunol* 162: 2227-34 (1999); Burrows S et al., *J Immunol* 165: 6229-34 (2000); Cheuk E et al., *J Immunol* 169: 5571-80 (2002); Elkington R et al, *J Virol* 77: 5226-40 (2003); Oh S et al., *Cancer Res* 64: 2610-8 (2004); Hopkins L et al., *Hum Immunol* 66: 874-83 (2005); Assarsson E et al, *J Virol* 12241-51 (2008); Semeniuk C et al., *AIDS* 23: 771-7 (2009); Wang X et al., *J Vis Exp* 61: 3657 (2012); Song H et al., *Virology* 447: 181-6 (2013); Chen L et al., *J Virol* 88: 11760-73 (2014)).

In many species, the MHC gene encodes multiple MHC-I molecular variants. Because MHC class I protein polymorphisms can affect antigen-MHC class I complex recognition by CD8+ T-cells, heterologous T-cell epitopes may be chosen based on knowledge about certain MHC class I polymorphisms and/or the ability of certain antigen-MHC class I complexes to be recognized by T-cells of different genotypes.

There are well-defined peptide-epitopes that are known to be immunogenic, MHC class I restricted, and/or matched with a specific human leukocyte antigen (HLA) variant(s). For applications in humans or involving human target cells, HLA-Class I-restricted epitopes can be selected or identified by the skilled worker using standard techniques known in the art. The ability of peptides to bind to human MHC Class I molecules can be used to predict the immunogenic potential of putative, CD8+ T-cell epitopes. The ability of peptides to bind to human MHC class I molecules can be scored using software tools. CD8+ T-cell epitopes may be chosen for use as a CD8+ heterologous, T-cell epitope component of the present invention based on the peptide selectivity of the HLA variants encoded by the alleles more prevalent in certain human populations. For example, the human population is polymorphic for the alpha chain of MHC class I molecules, and the variable alleles are encoded by the HLA genes. Certain T-cell epitopes may be more efficiently presented by a specific HLA molecule, such as, e.g., the commonly occurring HLA variants encoded by the HLA-A allele groups HLA-A2 and HLA-A3.

When choosing CD8+ T-cell epitopes for use as a heterologous, CD8+ T-cell epitope-peptide component of the cell-targeting molecule of the present invention, CD8+ epitopes may be selected which best match the MHC Class I molecules present in the cell-type or cell populations to be targeted. Different MHC class I molecules exhibit preferential binding to particular peptide sequences, and particular peptide-MHC class I variant complexes are specifically recognized by the TCRs of effector T-cells. The skilled worker can use knowledge about MHC class I molecule specificities and TCR specificities to optimize the selection of heterologous T-cell epitopes used in the present invention.

In certain embodiments of the cell-targeting molecule of the present invention, the heterologous, CD8+ T-cell epitope-peptide is comprised within a heterologous polypeptide, such as, e.g., an antigen or antigenic protein. In certain further embodiments, the heterologous polypeptide is no larger than 27 kDa, 28 kDa, 29 kDa, or 30 kDa.

In certain embodiments, the cell-targeting molecule of the present invention comprises two or more heterologous, CD8+ T-cell epitope-peptides. In certain further embodiments, the combined size of all the heterologous, CD8+ T-cell epitope-peptides is no larger than 27 kDa, 28 kDa, 29 kDa, or 30 kDa.

In certain embodiments of the cell-targeting molecule of the present invention, the heterologous, CD8+ T-cell epitope-peptide is processed better in cells with more immunoproteasomes, intermediate proteasomes, and/or thymoproteasomes as compared to standard proteasomes; however, in other embodiments the opposite is true.

When choosing CD8+ T-cell epitope-peptides for use as a heterologous, CD8+ T-cell epitope-peptide component of a cell-targeting molecule of the present invention, multiple factors in the MHC class I presentation system may be considered that can influence CD8+ T-cell epitope generation and transport to receptive MHC class I molecules, such as, e.g., the epitope specificity of the following factors in the target cell: proteasome, ERAAP/ERAP1, tapasin, and TAPs can (see e.g. Akram A, Inman R, *Clin Immunol* 143: 99-115 (2012)).

In certain embodiments of the cell-targeting molecule of the present invention, the heterologous, CD8+ T-cell epitope-peptide is only proteolytically processed in an intact form by an intermediate proteasome (see e.g. Guillaume B et al., *Proc Natl Acad Sci USA* 107: 18599-604 (2010); Guillaume B et al., *J Immunol* 189: 3538-47 (2012)).

In certain embodiments of the cell-targeting molecule of the present invention, the heterologous, CD8+ T-cell epitope-peptide is not destroyed by standard proteasomes, immunoproteasomes, intermediate proteasomes, and/or thymoproteasomes, which also may depend on the cell type, cytokine environment, tissue location, etc. (see e.g., Morel S et al., *Immunity* 12: 107-17 (2000); Chapiro J et al., *J Immunol* 176: 1053-61 (2006); Guillaume B et al., *Proc Natl Acad Sci U.S.A.* 107: 18599-604 (2010); Dalet A et al., *Eur J Immunol* 41: 39-46 (2011); Basler M et al., *J Immunol* 189: 1868-77 (2012); Guillaume B et al., *J Immunol* 189: 3538-47 (2012)).

In certain embodiments of the cell-targeting molecule of the present invention, the heterologous, CD8+ T-cell epitope-peptide is considered a "weak" epitope, such as, e.g., "weak" in vivo at eliciting a CD8+ CTL response in a given subject or genotype group or cells derived from the aforementioned (see e.g. Cao W et al., *J Immunol* 157: 505-11 (1996)).

In certain embodiments of the cell-targeting molecule of the present invention, the heterologous, CD8+ T-cell epitope-peptide is a tumor cell epitope, such as, e.g., NY-ESO-1 157-165A (see e.g. Jager E et al. *J Exp Med* 187: 265-70 (1998)).

In certain embodiments of the cell-targeting molecule of the present invention, the heterologous, CD8+ T-cell epitope-peptide has been modified to have a bulky or a charged residue at its amino terminus in order to increase ubiquitination (see e.g., Grant E et al., *J Immunol* 155: 3750-8 (1995); Townsend A et al., *J Exp Med* 168: 1211-24 (1998); Kwon Y et al., *Proc Natl Acad Sci U.S.A.* 95: 7898-903 (1998)).

In certain embodiments of the cell-targeting molecule of the present invention, the heterologous, CD8+ T-cell epitope-peptide has been modified to have a hydrophobic amino acid residue at its carboxy terminus in order to increase proteolytic cleavage probability (see e.g., Driscoll J et al., *Nature* 365: 262-4 (1993); Gaczynska M et al., *Nature* 365: 264-7 (1993)).

In certain embodiments of the cell-targeting molecule of the present invention, the heterologous, CD8+ T-cell epitope-peptide is a Tregitope. Tregitopes are functionally defined as epitope-peptides capable of inducing an immunosuppressive result. Examples of naturally occurring Tregitopes include sub-regions of human immunoglobulin G heavy chain constant regions (Fcs) and Fabs (see e.g., Sumida T et al., *Arthritis Rheum* 40: 2271-3 (1997); Bluestone J, Abbas A, *Nat Rev Immunol* 3: 253-7 (2003); Hahn B et al., *J Immunol* 175: 7728-37 (2005); Durinovic-Belló I et al., *Proc Natl Acad Sci USA* 103: 11683-8 (2006); Sharabi A et al., *Proc Natl Acad Sci USA* 103: 8810-5 (2006); De Groot A et al., *Blood* 112: 3303-11 (2008); Sharabi A et al., *J Clin Immunol* 30: 34-4 (2010); Mozes E, Sharabi A, *Autoimmun Rev* 10: 22-6 (2010)).

While the position of the heterologous, CD8+ T-cell epitope-peptide of the cell-targeting molecule of the present invention is not generally restricted. In certain embodiments of the present invention, the heterologous, CD8+ T-cell epitope-peptide is linked to the cell-targeting molecule at a location carboxy-terminal to the Shiga toxin A1 fragment derived region.

In certain embodiments, the cell-targeting molecule comprises two or more heterologous, CD8+ T-cell epitope-peptides. In certain further embodiments, the multiple heterologous, CD8+ T-cell epitope-peptides are derived from different species, such as, e.g., different microorganism species. In certain further embodiments, the two or more, heterologous, CD8+ T-cell epitope peptides are from a bacterium and a virus or two or more different bacterial species (see e.g. Engelhorn M et al., *Mol Ther* 16: 773-81 (2008)). In certain further embodiments, the two or more, heterologous, CD8+ T-cell epitope peptides are from a microorganism and a human cancer cell.

C. Cell-Targeting Binding Regions

The cell-targeting molecules of the present invention comprise a cell-targeting binding region capable of specifically binding an extracellular target biomolecule.

In certain embodiments, a binding region of a cell-targeting molecule of the present invention is a cell-targeting component, such as, e.g., a domain, molecular moiety, or agent, capable of binding specifically to an extracellular part of a target biomolecule (e.g. an extracellular target biomolecule) with high affinity. There are numerous types of binding regions known to skilled worker or which may be discovered by the skilled worker using techniques known in the art. For example, any cell-targeting component that exhibits the requisite binding characteristics described herein may be used as the binding region in certain embodiments of the cell-targeting molecules of the present invention.

An extracellular part of a target biomolecule refers to a portion of its structure exposed to the extracellular environment when the molecule is physically coupled to a cell, such as, e.g., when the target biomolecule is expressed at a cellular surface by the cell. In this context, exposed to the extracellular environment means that part of the target biomolecule is accessible by, e.g., an antibody or at least a binding moiety smaller than an antibody such as a single-domain antibody domain, a nanobody, a heavy-chain antibody domain derived from camelids or cartilaginous fishes, a single-chain variable fragment, or any number of engineered alternative scaffolds to immunoglobulins (see below). The exposure to the extracellular environment of or accessibility to a part of target biomolecule physically coupled to a cell may be empirically determined by the skilled worker using methods well known in the art.

A binding region of a cell-targeting molecule of the present invention may be, e.g., a ligand, peptide, immunoglobulin-type binding region, monoclonal antibody, engineered antibody derivative, or engineered alternative to antibodies.

In certain embodiments, the binding region of a cell-targeting molecule of the present invention is a proteinaceous moiety capable of binding specifically to an extracellular part of target biomolecule with high affinity. A binding region of a cell-targeting molecule of the present invention may comprise one or more various peptidic or polypeptide moieties, such as randomly generated peptide sequences, naturally occurring ligands or derivatives thereof, immunoglobulin derived domains, synthetically engineered scaffolds as alternatives to immunoglobulin domains, and the like (see e.g., WO 2005/092917; WO 2007/033497; Cheung M et al., *Mol Cancer* 9: 28 (2010); US2013/196928; WO 2014/164693; WO 2015/113005; WO 2015/113007; WO 2015/138452; WO 2015/191764). In certain embodiments, a cell-targeting molecule of the present invention comprises a binding region comprising one or more polypeptides capable of selectively and specifically binding an extracellular target biomolecule.

There are numerous binding regions known in the art that are useful for targeting molecules to specific cell-types via their binding characteristics, such as certain ligands, monoclonal antibodies, engineered antibody derivatives, and engineered alternatives to antibodies.

According to one specific but non-limiting aspect, the binding region of a cell-targeting molecule of the present invention comprises a naturally occurring ligand or derivative thereof that retains binding functionality to an extracellular target biomolecule, commonly a cell surface receptor. For example, various cytokines, growth factors, and hormones known in the art may be used to target the cell-targeting molecule of the present invention to the cell-surface of specific cell-types expressing a cognate cytokine receptor, growth factor receptor, or hormone receptor. Certain non-limiting examples of ligands include (alternative names are indicated in parentheses) angiogenin, B-cell activating factors (BAFFs, APRIL), colony stimulating factors (CSFs), epidermal growth factors (EGFs), fibroblast growth factors (FGFs), vascular endothelial growth factors (VEGFs), insulin-like growth factors (IGFs), interferons, interleukins (such as IL-2, IL-6, and IL-23), nerve growth factors (NGFs), platelet derived growth factors, transforming growth factors (TGFs), and tumor necrosis factors (TNFs).

According to certain other embodiments of the cell-targeting molecules of the present invention, the binding region comprises a synthetic ligand capable of binding an extracellular target biomolecule (see e.g. Liang S et al., *J Mol Med* 84: 764-73 (2006); Ahmed S et al., *Anal Chem* 82: 7533-41 (2010); Kaur K et al., *Methods Mol Biol* 1248: 239-47 (2015)).

In certain embodiments, the binding region comprises a peptidomimetic, such as, e.g., an AApeptide, gamma-AApeptide, and/or sulfono-γ-AApeptide (see e.g., Pilsl L, Reiser O, *Amino Acids* 41: 709-18 (2011); Akram O et al., *Mol Cancer Res* 12: 967-78 (2014); Wu H et al., *Chemistry* 21: 2501-7 (2015); Teng P et al., *Chemistry* 2016 Mar. 4)).

According to one specific, but non-limiting aspect, the binding region may comprise an immunoglobulin-type binding region. The term "immunoglobulin-type binding region" as used herein refers to a polypeptide region capable of binding one or more target biomolecules, such as an antigen or epitope. Binding regions may be functionally defined by their ability to bind to target molecules. Immunoglobulin-type binding regions are commonly derived from antibody or antibody-like structures; however, alternative scaffolds from other sources are contemplated within the scope of the term.

Immunoglobulin (Ig) proteins have a structural domain known as an Ig domain. Ig domains range in length from about 70-110 amino acid residues and possess a characteristic Ig-fold, in which typically 7 to 9 antiparallel beta strands arrange into two beta sheets which form a sandwich-like structure. The Ig fold is stabilized by hydrophobic amino acid interactions on inner surfaces of the sandwich and highly conserved disulfide bonds between cysteine residues in the strands. Ig domains may be variable (IgV or V-set), constant (IgC or C-set) or intermediate (IgI or I-set). Some Ig domains may be associated with a complementarity determining region (CDR), also called a "complementary determining region," which is important for the specificity of antibodies binding to their epitopes. Ig-like domains are also found in non-immunoglobulin proteins and are classified on that basis as members of the Ig superfamily of proteins. The HUGO Gene Nomenclature Committee (HGNC) provides a list of members of the Ig-like domain containing family.

An immunoglobulin-type binding region may be a polypeptide sequence of an antibody or antigen-binding fragment thereof wherein the amino acid sequence has been varied from that of a native antibody or an Ig-like domain of a non-immunoglobulin protein, for example by molecular engineering or selection by library screening. Because of the relevance of recombinant DNA techniques and in vitro library screening in the generation of immunoglobulin-type binding regions, antibodies can be redesigned to obtain desired characteristics, such as smaller size, cell entry, or other improvements for in vivo and/or therapeutic applications. The possible variations are many and may range from the changing of just one amino acid to the complete redesign of, for example, a variable region. Typically, changes in the variable region will be made in order to improve the antigen-binding characteristics, improve variable region stability, or reduce the potential for immunogenic responses.

There are numerous immunoglobulin-type binding regions contemplated as components of the present invention. In certain embodiments, the immunoglobulin-type binding region is derived from an immunoglobulin binding region, such as an antibody paratope capable of binding an extracellular target biomolecule. In certain other embodiments, the immunoglobulin-type binding region comprises an engineered polypeptide not derived from any immunoglobulin domain but which functions like an immunoglobulin binding region by providing high-affinity binding to an extracellular target biomolecule. This engineered polypeptide may optionally include polypeptide scaffolds comprising or consisting essentially of complementary determining regions from immunoglobulins as described herein.

There are also numerous binding regions in the prior art that are useful for targeting polypeptides to specific cell-types via their high-affinity binding characteristics. In certain embodiments of the cell-targeting molecules of the present invention, the binding region comprises immunoglobulin domain selected from the group which includes autonomous $V_H$ domains, single-domain antibody domains (sdAbs), heavy-chain antibody domains derived from camelids ($V_HH$ fragments or $V_H$ domain fragments), heavy-chain antibody domains derived from camelid $V_HH$ fragments or $V_H$ domain fragments, heavy-chain antibody domains derived from cartilaginous fishes, immunoglobulin new antigen receptors (IgNARs), $V_{NAR}$ fragments, single-chain variable (scFv) fragments, nanobodies, Fd fragments consisting of the heavy chain and $C_H1$ domains, antibody variable domain (Fv) fragments, permutated Fvs (pFv), single chain Fv-$C_H3$ minibodies, dimeric $C_H2$ domain fragments ($C_H2D$), Fc antigen binding domains (Fcabs), isolated complementary determining region 3 (CDR3) fragments, constrained framework region 3, CDR3, framework region 4 (FR3-CDR3-FR4) polypeptides, small modular immunopharmaceutical (SMIP) domains, scFv-Fc fusions, one-arm single-chain Fab constructs, multimerizing scFv fragments (diabodies, triabodies, tetrabodies), disulfide-stabilized antibody variable (Fv) fragments, disulfide-stabilized antigen-binding (Fab) fragments consisting of the $V_L$, $V_H$, $C_L$ and $C_H1$ domains, bivalent nanobodies, bivalent minibodies, bivalent F(ab')$_2$ fragments (Fab dimers), bispecific tandem $V_HH$ fragments, bispecific tandem scFv fragments, bispecific nanobodies, bispecific minibodies, one-arm single-chain Fab heterodimeric bispecific constructs, and any genetically manipulated counterparts of the foregoing that retains its binding functionality (Brinkmann U et al., *J Mol Biol* 268: 107-17 (1997); Wörn A, Pluckthun A, *J Mol Biol* 305: 989-1010 (2001); Xu L et al., *Chem Biol* 9: 933-42 (2002); Wikman M et al., *Protein Eng Des Sel* 17: 455-62 (2004); Binz H et al., *Nat Biotechnol* 23: 1257-68 (2005); Hey T et al., *Trends Biotechnol* 23:514-522 (2005); Holliger P, Hudson P, *Nat Biotechnol* 23: 1126-36 (2005); Gill D, Damle N, *Curr Opin Biotech* 17: 653-8 (2006); Koide A, Koide S, *Methods Mol Biol* 352: 95-109 (2007); Byla P et al., *J Biol Chem* 285: 12096 (2010); Zoller F et al., *Molecules* 16: 2467-85 (2011); Alfarano P et al., *Protein Sci* 21: 1298-314 (2012); Madhurantakam C et al., *Protein Sci* 21: 1015-28 (2012); Varadamsetty G et al., *J Mol Biol* 424: 68-87 (2012); Reichen C et al., *J Struct Biol* 185: 147-62 (2014); Schanzer J et al., *J Biol Chem* 289: 18693-706 (2014)).

In certain embodiments, the binding region of the cell-targeting molecule of the present invention is selected from the group which includes autonomous $V_H$ domains (such as, e.g., from camelids, murine, or human sources), single-domain antibody domains (sdAbs), heavy-chain antibody domains derived from camelids ($V_HH$ fragments or $V_H$ domain fragments), heavy-chain antibody domains derived from camelid $V_HH$ fragments or $V_H$ domain fragments, heavy-chain antibody domains derived from cartilaginous fishes, immunoglobulin new antigen receptors (IgNARs), $V_{NAR}$ fragments, single-chain variable (scFv) fragments, nanobodies, "camelized" or "camelised" scaffolds comprising a $V_H$ domain, Fd fragments consisting of the heavy chain and $C_H1$ domains, single chain Fv-$C_H3$ minibodies, dimeric $C_H2$ domain fragments ($C_H2D$), Fc antigen binding domains (Fcabs), isolated complementary determining region 3 (CDR3) fragments, constrained framework region 3, CDR3, framework region 4 (FR3-CDR3-FR4) polypeptides, small modular immunopharmaceutical (SMIP) domains, scFv-Fc fusions, multimerizing scFv fragments (diabodies, triabodies, tetrabodies), disulfide-stabilized antibody variable (Fv) fragments (dsFv), disulfide-stabilized antigen-binding (Fab) fragments consisting of the $V_L$, $V_H$, $C_L$ and $C_H1$ domains, single-chain variable-region fragments comprising a disulfide-stabilized heavy and light chain (sc-dsFvs), bivalent nanobodies, bivalent minibodies, bivalent F(ab')$_2$ fragments (Fab dimers), bispecific tandem $V_HH$ fragments, bispecific tandem scFv fragments, bispecific nanobodies, bispecific minibodies, and any genetically manipulated counterparts of the foregoing that retain its paratope and binding function (see Ward E et al., *Nature* 341: 544-6 (1989); Davies J, Riechmann L, *Biotechnology* (NY) 13: 475-9 (1995); Reiter Y et al., *Mol Biol* 290: 685-98 (1999); Riechmann L, Muyldermans S, *J Immunol Methods* 231: 25-38 (1999); Tanha J et al., *J Immunol Methods* 263: 97-109 (2002); Vranken W et al., *Biochemistry* 41: 8570-9 (2002); Dottorini T et al., *Biochemistry* 43: 622-8 (2004); Jespers L et al., *J Mol Biol* 337: 893-903 (2004); Jespers L et al., *Nat Biotechnol* 22: 1161-5 (2004); Spinelli S et al., *FEBS Lett* 564: 35-40 (2004); To R et al., *J Biol Chem* 280: 41395-403 (2005); Tanha J et al., *Protein Eng Des Sel* 19: 503-9 (2006); Saerens D et al., *Curr Opin Pharmacol* 8: 600-8 (2008); Dimitrov D, *MAbs* 1: 26-8 (2009); Chen I et al., *Mol Biosyst* 6: 1307-15 (2010); Huang Y et al., *J Biol Chem* 285: 7880-91 (2010); Lee et al., *Biochem Biophys Res Commun* 411: 348-53 (2011); Ahmad Z et al., *Clin Dev Immunol* 2012: 980250 (2012); Baral T et al., *PLoS One* 7: e30149 (2012); Weiner L, *Cell* 148: 1081-4 (2012)).

In certain embodiments, the binding region of a molecule of the present invention is multivalent and bispecific but the specificity is to a single target, i.e. the bispecificity is due to different binding regions binding different extracellular epitopes present on the same or a single extracellular target biomolecule (see e.g. Schanzer J et al., *Antimicrob Agents Chemother* 55: 2369-78 (2011)).

Immunoglobulin domains and/or fragments may be modified for use as a cell-targeting moiety in a cell-targeting molecule of the present invention by the addition or removal of a cysteine residue(s) and/or disulfide bond(s) and/or modification of other residues (see e.g. Young N et al., *FEBS Lett* 377: 135-9 (1995); Wirtz P, Steipe B, *Protein Sci* 8: 2245-50 (1999); Barthelemy P et al., *J Biol Chem* 283: 3639-54 (2008); Arabi-Ghahroudi M et al., *Protein Eng Des Sel* 22: 59-66 (2009); Zhao J et al., *Int J Mol Sci* 12: 1-11 (2010); Duan Y et al., *Mol Immunol* 51: 188-96 (2012); Kim D et al., *Protein Eng Des Sel* 25: 581-9 (2012) Gil D, Schrum A, *Adv Biosci Biotechnol* 4: 73-84 (2013)).

In certain embodiments, the cell-targeting molecule of the present invention comprises an immunoglobulin-type binding region which comprises an immunoglobulin domain and/or Ig-fold structure having an intra-domain disulfide bond, such as, e.g., the disulfide bond found natively between the B and F β strands of certain immunoglobulins and/or a disulfide bond between their heavy and light chains of or derived from an immunoglobulin. However, in certain embodiments of the cell-targeting molecule of the present invention, the molecules are very stable even though they do not comprise an intra-domain disulfide bond or any intra-domain disulfide bond within one or more immunoglobulin-type binding regions (see e.g. Proba K et al., *Biochemistry* 37: 13120-7 (1998); Wörn A, Plückthun A, *Biochemistry* 37: 13120-7 (1998); Wörn A, Pluckthun A, *FEBS Lett* 427: 357-61 (1998); Ramm K et al., *J Mol Biol* 290: 535-46 (1999); Tanaka T, Rabbitts T, *J Mol Biol* 376: 749-57 (2008)).

In certain embodiments, cell-targeting molecule of the present invention comprises an immunoglobulin-type binding region derived from an immunoglobulin which has been engineered with certain camelid $V_HH$ "tetrad" mutations to improve solubility, to improve stability, and/or otherwise "camelize" the binding region (see e.g. Vincke C et al., *J Biol Chem* 284: 3273-84 (2009); Perchiacca J et al., *Proteins* 79: 2637-47 (2011); Gil D, Schrum A, *Adv Biosci Biotechnol* 4: 73-84 (2013)).

The skilled worker may use numerous approaches known in the art to minimize and/or prevent aggregation of molecules comprising immunoglobulin domains and/or fragments or otherwise comprising components derived from immunoglobulins (see e.g. Jespers L et al., *Nat Biotechnol* 22: 1161-5 (2004); Daugherty A, Mrsny R, *Adv Drug Deliv Rev* 58: 686-706 (2006); Christ D et al., *Protein Eng Des Sel* 20: 413-6 (2007); Wang W et al., *J Pharma Sci* 96: 1-26 (2007); Famm K et al., *J Mol Biol* 376: 926-31 (2008); Arabi-Ghahroudi M et al., *Protein Eng Des Sel* 22: 59-66 (2009); Wang X et al., *MAbs* 1: 254-267 (2009); Dudgeon K et al., *Proc Natl Acad Sci USA* 109: 10879-84 (2012); Kim D et al., *Methods Mol Biol* 911: 355-72 (2012); Perchiacca J et al., *Protein Eng Des Sel* 25: 591-601 (2012); Schaefer J, Plückthun A, *J Mol Biol* 417: 309-335 (2012); Buchanan A et al., *MAbs* 5: 255-62 (2013); Lee C et al., *Trends Biotechnol* 31: 612-20 (2013); Tiller T et al., *MAbs* 5: 445-470 (2013); Kim D et al., *Biochim Biophys Acta* 1844: 1983-2001 (2014); Perchiacca J et al., *Protein Eng Des Sel* 27: 29-39 (2014); Rouet R et al., *FEBS Lett* 588: 269-77 (2014); Swift J et al., *Protein Eng Des Sel* 27: 405-9 (2014); Enever C et al., *Protein Eng Des Sel* 28: 59-68 (2015)).

The skilled worker may use the addition or maintenance of intermolecular disulfide bonds to stabilize certain binding regions of the cell-targeting molecules of the present invention (see e.g. Glockshuber R et al., *Biochemistry* 29: 1362-7 (1990); Stanfield R et al., *Science* 305: 1770-3 (2004); Hagihara Y et al., *J Biol Chem* 282: 36489-95 (2007); Chan P et al., *Biochemistry* 47: 11041-54 (2008); Saerens D et al., *J Mol Biol* 478-88 (2008); Hussack G et al., *PLoS One* 6: e28218 (2011); Govaert J et al., *J Biol Chem* 287: 1970-9 (2012); Kim D et al., *Protein Eng Des Sel* 25: 581-9 (2012); Gil D, Schrum A, *Adv Biosci Biotechnol* 4: 73-84 (2013); McConnell A et al., *Protein Eng Des Sel* 25: 581-9 (2013); Feige M et al., *Proc Natl Acad Sci USA* 111: 8155-60 (2014); Hagihara Y, Saerens D, *Biochim Biophys Acta* 1844: 2016-2023 (2014); Kim D et al., *Mabs* 6: 219-35 (2014)).

For example, in certain embodiments, the cell-targeting molecule of the present invention is engineered to minimize the formation of unwanted, intermolecular associations, multimers, and/or aggregates, such as, e.g., by using disulfide-stabilized scFvs, Fv fragments, or Fabs (see e.g. Reiter Y et al., *J Biol Chem* 269: 18327-31 (1994); Kuan C, Pastan I, *Biochemistry* 35: 2872-7 (1996); Almog O et al., *Proteins* 31: 128-38 (1998); Schoonjans R et al., *J Immunol* 165: 7050-7 (2000); Olafsen T et al., *Protein Eng Des Sel* 17: 21-7 (2004); Gil D, Schrum A, *Adv Biosci Biotechnol* 4: 73-84 (2013); U.S. 20120283418); base loop connections (see e.g. Brinkmann U et al., *J Mol Biol* 268: 107-17 (1997)); and/or other modifications, such as the addition of charged resides, glycans, and/or immunoglobulin-domain truncations (see e.g. Gong R et al., *Mol Pharm* 10: 2642-52 (2013); Lee C et al., *Trends Biotechnol* 31: 612-20 (2013); Goldman E et al., *Protein Expr Purif* 95: 226-32 (2014)).

In certain embodiments of the present invention, the cell-targeting molecule of the present invention comprises an immunoglobulin-type binding region which is an scFv engineered not to aggregate, such as, e.g., by using a shorter linker (typically less than twelve amino acid residues) and/or disulfide-stabilized linker that links the heavy and light chain regions of the scFv (see e.g., Brinkmann U et al., *Proc Natl Acad Sci USA* 90: 7538-42 (1993); Whitlow M et al., *Protein Engineering* 6: 989-95 (1993); Reiter Y et al., *Biochemistry* 33: 5451-9 (1994); Gong R et al., *Molecular Pharmaceutics* 10: 2642-52 (2013)).

There are a variety of binding regions comprising polypeptides derived from the constant regions of immunoglobulins which may be used a binding region(s) of a cell-targeting molecule of the present invention, such as, e.g., engineered dimeric Fc domains, monomeric Fcs (mFcs), scFv-Fcs, $V_HH$-Fcs, $C_H2$ domains, monomeric $C_H3s$ domains (m$C_H3s$), synthetically reprogrammed immunoglobulin domains, and/or hybrid fusions of immunoglobulin domains with ligands (Hofer T et al., *Proc Natl Acad Sci USA* 105: 12451-6 (2008); Xiao J et al., *J Am Chem Soc* 131: 13616-8 (2009); Xiao X et al., *Biochem Biophys Res Commun* 387: 387-92 (2009); Wozniak-Knopp G et al., *Protein Eng Des Sel* 23 289-97 (2010); Gong R et al., *PLoS ONE* 7: e42288 (2012); Wozniak-Knopp G et al., *PLoS ONE* 7: e30083 (2012); Ying T et al., *J Biol Chem* 287: 19399-408 (2012); Ying T et al., *J Biol Chem* 288: 25154-64 (2013); Chiang M et al., *J Am Chem Soc* 136: 3370-3 (2014); Rader C, *Trends Biotechnol* 32: 186-97 (2014); Ying T et al., *Biochimica Biophys Acta* 1844: 1977-82 (2014)).

In accordance with certain other embodiments, the binding region comprises an immunoglobulin domain(s) that is not from a traditional immunoglobulin but rather is from a cell-membrane bound receptor which functions as part of the immune system. In certain embodiments, the cell-targeting binding region of the cell-targeting molecule of the present invention comprises or consists essentially of a single-chain T-cell receptor variable fragment (scTv), a single-chain TCR (scTCR), disulfide-stabilized T-cell receptor variable fragment (dsTv), and/or T-cell receptor variable fragment disulfide-stabilized Fv heterodimer (TCR dsFv heterodimer).

In certain embodiments, the cell-targeting binding region of the cell-targeting molecule of the present invention is a soluble, single-chain T-cell receptor variable fragment (soluble scTv) and/or TCR dsFv heterodimer (see e.g. Novotny J et al., *Proc Natl Acad Sci USA* 88: 8646-50 (1991); Soo Hoo, W et al., *Proc Natl Acad Sci USA* 89: 4759-63 (1992); Shusta E et al., *J Mol Biol* 292: 949-56 (1999); Holler P et al., *Proc Natl Acad Sci USA* 97: 5387-92 (2000); Boulter J et al., *Protein Eng* 16: 707-11 (2003); Li Y et al., *Nat Biotechnol* 23: 349-54 (2005); Weber K et al., *Proc Natl Acad Sci USA* 102: 19033-8 (2005); Dunn S et al., *Protein Sci* 15: 710-21 (2006); Richman S, Kranz D, *Biomol Eng* 24: 361-73 (2007); Varela-Rohena A et al., *Nat Med* 14: 1390-5 (2008); Sadelain M et al., *Curr Opin Immunol* 21: 215-23 (2009); Aggen D et al., *Protein Eng Des Sel* 24: 361-72 (2011); WO1999060120; WO2001057211; WO2003020763; U.S. Pat. No. 7,329,731). Unlike most immunoglobulins, naturally occurring scTvs typically bind with moderate affinity to an epitope-peptide-MHC protein complex. While scTvs in isolation bind to such cell-surface targets (i.e. extracellular target biomolecules physically coupled to cells in the form of pMHCs), scTvs also can retain their binding specificity for cell-targeting upon fusion to an effector molecule, such as a toxin protein (see e.g. Epel M et al., *Cancer Immunol Immunother* 51: 563-73 (2002)). While such scTv's can be engineered to recognize new targets with high-affinity binding, specificity and selectivity, the targets are typically MHC protein-non-self epitope-peptide complexes which are displayed on the surfaces of vertebrate cells. However, naturally occurring TCRs which have been deleted during thymic selection often bind self-epitope-MHC complexes with high affinities. Furthermore, the scTv may be mutated in its variable domain(s) to improve the affinity and/or stability of desired binding interactions (see e.g. Shusta E et al., *Nat Biotechnol* 18: 754-9 (2000); Richman S et al., *Mol Immunol* 46: 902-16 (2009)). The introduction of solubility increasing mutations in a scTCR and/or a non-native disulfide bond in the TCR invariant region, to make dsTCRs, can greatly increase the stability and folding characteristics of a scTv (see e.g. Molloy P et al., *Curr Opin Pharmacol* 5: 438-43 (2005); WO2003020763). In addition, it may improve stability and production of a scTv by orienting the domains of the scTCR in the amino-to-carboxy orientation of Vα domain-linker-Vβ domain (Loset G et al., *Protein Eng Des Sel* 20: 461-72 (2007); Richman S et al., *Mol Immunol* 46: 902-16 (2009)). The introduction of various mutations may also improve expression in a host cell system, e.g. in yeast cells (see e.g. Richman S et al., *Mol Immunol* 46: 902-16 (2009)).

In accordance with certain other embodiments, the binding region comprises an engineered, alternative scaffold to immunoglobulin domains. Engineered alternative scaffolds are known in the art which exhibit similar functional characteristics to immunoglobulin-derived structures, such as high-affinity and specific binding of target biomolecules, and may provide improved characteristics to certain immunoglobulin domains, such as, e.g., greater stability or reduced immunogenicity. Generally, alternative scaffolds to immunoglobulins are less than 20 kilodaltons (kDa), consist of a single polypeptide chain, lack cysteine residues, and exhibit relatively high thermodynamic stability.

In certain embodiments of the cell-targeting molecules of the present invention, the immunoglobulin-type binding region is selected from the group which includes engineered, Armadillo repeat polypeptides (ArmRPs); engineered, fibronectin-derived, $10^{th}$ fibronectin type III (10Fn3) domains (monobodies, AdNectins™, or AdNexins™); engineered, tenascin-derived, tenascin type III domains (Centryns™); engineered, ankyrin repeat motif containing polypeptides (DARPins™); engineered, low-density-lipoprotein-receptor-derived, A domains (LDLR-A) (Avimers™); lipocalins (anticalins); engineered, protease inhibitor-derived, Kunitz domains; engineered, Protein-A-derived, Z domains (Affibodies™); engineered, gamma-B crystallin-derived scaffold or engineered, ubiquitin-derived scaffolds (Affilins); Sac7d-derived polypeptides (Nanoffitins® or affitins); engineered, Fyn-derived, SH2 domains (Fynomers®); and engineered antibody mimics and any genetically manipulated counterparts of the foregoing that retains its binding functionality (Wörn A, Plückthun A, *J Mol Biol* 305: 989-1010 (2001); Xu L et al., *Chem Biol* 9: 933-42 (2002); Wikman M et al., *Protein Eng Des Sel* 17: 455-62 (2004); Binz H et al., *Nat Biotechnol* 23: 1257-68 (2005); Hey T et al., *Trends Biotechnol* 23:514-522 (2005); Holliger P, Hudson P, *Nat Biotechnol* 23: 1126-36 (2005); Gill D, Damle N, *Curr Opin Biotech* 17: 653-8 (2006); Koide A, Koide S, *Methods Mol Biol* 352: 95-109 (2007); Byla P et al., *J Biol Chem* 285: 12096 (2010); Zoller F et al., *Molecules* 16: 2467-85 (2011); Alfarano P et al., *Protein Sci* 21: 1298-314 (2012); Madhurantakam C et al., *Protein Sci* 21: 1015-28 (2012); Varadamsetty G et al., *J Mol Biol* 424: 68-87 (2012)).

For example, there is an engineered Fn3(CD20) binding region scaffold which exhibits high-affinity binding to CD20 expressing cells (Natarajan A et al., *Clin Cancer Res* 19: 6820-9 (2013)).

For example, numerous alternative scaffolds have been identified which bind to the extracellular receptor HER2 (see e.g. Wikman M et al., *Protein Eng Des Sel* 17: 455-62 (2004); Orlova A et al. *Cancer Res* 66: 4339-8 (2006); Ahlgren S et al., *Bioconjug Chem* 19: 235-43 (2008); Feldwisch J et al., *J Mol Biol* 398: 232-47 (2010); U.S. Pat. Nos. 5,578,482; 5,856,110; 5,869,445; 5,985,553; 6,333,169; 6,987,088; 7,019,017; 7,282,365; 7,306,801; 7,435,797; 7,446,185; 7,449,480; 7,560,111; 7,674,460; 7,815,906; 7,879,325; 7,884,194; 7,993,650; 8,241,630; 8,349,585; 8,389,227; 8,501,909; 8,512,967; 8,652,474; and U.S. patent application 20110059090). In addition to alternative antibody formats, antibody-like binding abilities may be conferred by non-proteinaceous compounds, such as, e.g., oligomers, RNA molecules, DNA molecules, carbohydrates, and glycocalyxcalixarenes (see e.g. Sansone F, Casnati A, *Chem Soc Rev* 42: 4623-39 (2013)) or partially proteinaceous compounds, such as, e.g., phenol-formaldehyde cyclic oligomers coupled with peptides and calixarene-peptide compositions (see e.g. U.S. Pat. No. 5,770,380).

In certain embodiments, it may be preferable to use protease-resistant immunoglobulin domains and/or synthetically stabilized scFv fragments, such as to avoid instability during storage or after administration but before reaching a target cell (see e.g. Ewert S et al., *Methods* 34: 184-99 (2004); Honegger et al., *Protein Eng Des Sel* 22: 135-47 (2009); Miller et al., *Protein Eng Des Sel* 23: 549-57 (2010); Hussack G et al., *Protein Eng Des Sel* 27: 191-8 (2014)).

Any of the above binding region structures may be used as a component of a cell-targeting molecule of the present invention as long as the binding region component has a dissociation constant of $10^{-5}$ to $10^{-12}$ moles per liter, preferably less than 200 nanomolar (nM), towards an extracellular target biomolecule.

In certain embodiments, the cell-targeting molecules of the present invention comprise a Shiga toxin effector polypeptide of the present invention linked and/or fused to a binding region capable of specifically binding an extracellular part of a target biomolecule or an extracellular target biomolecule. Extracellular target biomolecules may be selected based on numerous criteria, such as a criterion described herein.

Extracellular Target Biomolecules Bound by the Binding Regions

In certain embodiments, the binding region of a cell-targeting molecules of the present invention comprises a proteinaceous region capable of binding specifically to an extracellular part of a target biomolecule or an extracellular target biomolecule, preferably which is physically coupled to the surface of a cell-type of interest, such as, e.g., a cancer cell, tumor cell, plasma cell, infected cell, or host cell harboring an intracellular pathogen. Preferably, the targeted cell-type will be expressing a MHC class I molecule(s). Target biomolecules bound by the binding region of a cell-targeting molecule of the present invention may include biomarkers over-proportionately or exclusively present on cancer cells, immune cells, and/or cells infected with intracellular pathogens, such as, e.g., viruses, bacteria, fungi, prions, or protozoans.

The term "target biomolecule" refers to a biological molecule, commonly a proteinaceous molecule or a protein modified by post-translational modifications, such as glycosylation, that is bound by a binding region of a cell-targeting molecule of the present invention resulting in the targeting of the cell-targeting molecule to a specific cell, cell-type, and/or location within a multicellular organism.

For purposes of the present invention, the term "extracellular" with regard to a target biomolecule refers to a biomolecule that has at least a portion of its structure exposed to the extracellular environment. The exposure to the extracellular environment of or accessibility to a part of target biomolecule coupled to a cell may be empirically determined by the skilled worker using methods well known in the art. Non-limiting examples of extracellular target biomolecules include cell membrane components, transmembrane spanning proteins, cell membrane-anchored biomolecules, cell-surface-bound biomolecules, and secreted biomolecules.

With regard to the present invention, the phrase "physically coupled" when used to describe a target biomolecule means covalent and/or non-covalent intermolecular interactions couple the target biomolecule, or a portion thereof, to the outside of a cell, such as a plurality of non-covalent interactions between the target biomolecule and the cell where the energy of each single interaction is on the order of at least about 1-5 kiloCalories (e.g., electrostatic bonds, hydrogen bonds, ionic bonds, Van der Walls interactions, hydrophobic forces, etc.). All integral membrane proteins can be found physically coupled to a cell membrane, as well as peripheral membrane proteins. For example, an extracellular target biomolecule might comprise a transmembrane spanning region, a lipid anchor, a glycolipid anchor, and/or be non-covalently associated (e.g. via non-specific hydrophobic interactions and/or lipid binding interactions) with a factor comprising any one of the foregoing.

Extracellular parts of target biomolecules may include various epitopes, including unmodified polypeptides, polypeptides modified by the addition of biochemical functional groups, and glycolipids (see e.g. U.S. Pat. No. 5,091,178; EP2431743).

The binding regions of the cell-targeting molecules of the present invention may be designed or selected based on numerous criteria, such as the cell-type specific expression of their target biomolecules, the physical localization of their target biomolecules with regard to specific cell-types, and/or the properties of their target biomolecules. For example, certain cell-targeting molecules of the present invention comprise binding regions capable of binding cell-surface target biomolecules that are expressed at a cellular surface exclusively by only one cell-type of a species or only one cell-type within a multicellular organism. It is desirable, but not necessary, that an extracellular target biomolecule be intrinsically internalized or be readily forced to internalize upon interacting with a cell-targeting molecule of the present invention.

It will be appreciated by the skilled worker that any desired target biomolecule may be used to design or select a suitable binding region to be associated and/or coupled with a Shiga toxin effector polypeptide to produce a cell-targeting molecule of the present invention.

The general structure of the cell-targeting molecules of the present invention is modular, in that various, diverse cell-targeting binding regions may be used with various Shiga toxin effector polypeptides and CD8+ T-cell epitope-peptides to provide for diverse targeting and delivery of various epitopes to the MHC class I system of diverse target cell-types. Optionally, a cell-targeting molecule of the invention (e.g. protein) may further comprise a carboxy-terminal endoplasmic retention/retrieval signal motif, such as, e.g., the amino acids KDEL at the carboxy terminus of a proteinaceous component of the cell-targeting molecule (see e.g. PCT/US2015/19684).

D. Linkages Connecting Components of the Cell-Targeting Molecules of the Invention Individual cell-targeting binding regions, Shiga toxin effector polypeptides, CD8+ T-cell epitope cargos, and/or other components of the cell-targeting molecules present invention may be suitably linked to each other via one or more linkers well known in the art and/or described herein (see e.g., WO 2014/164693; WO 2015/113005; WO 2015/113007; WO 2015/138452; WO 2015/191764). Individual polypeptide subcomponents of the binding regions, e.g. heavy chain variable regions ($V_H$), light chain variable regions ($V_L$), CDR, and/or ABR regions, may be suitably linked to each other via one or more linkers well known in the art and/or described herein. Proteinaceous components of the invention, e.g., multi-chain binding regions, may be suitably linked to each other or other polypeptide components of the invention via one or more linkers well known in the art. Peptide components of the invention, e.g., a heterologous, CD8+ T-cell epitope-peptide cargos, may be suitably linked to another component of the invention via one or more linkers, such as a proteinaceous linker, which is well known in the art.

Suitable linkers are generally those which allow each polypeptide component of the present invention to fold with a three-dimensional structure very similar to the polypeptide components produced individually without any linker or another component associated with it. Suitable linkers include single amino acids, peptides, polypeptides, and linkers lacking any of the aforementioned, such as various non-proteinaceous carbon chains, whether branched or cyclic (see e.g. Alley S et al., *Bioconjug Chem* 19: 759-65 (2008); Ducry L, Stump B, *Bioconjug Chem* 21: 5-13 (2010)).

Suitable linkers may be proteinaceous and comprise one or more amino acids, peptides, and/or polypeptides. Proteinaceous linkers are suitable for both recombinant fusion proteins and chemically linked conjugates. A proteinaceous linker typically has from about 2 to about 50 amino acid residues, such as, e.g., from about 5 to about 30 or from about 6 to about 25 amino acid residues. The length of the linker selected will depend upon a variety of factors, such as, e.g., the desired property or properties for which the linker is being selected. In certain embodiments, the linker is proteinaceous and is linked near the terminus of a protein component of the present invention, typically within about 20 amino acids of the terminus. Frequently, suitable proteinaceous linkers comprise stretches of glycines and/or serines for flexibility combined with one or more charged residues, such as, e.g., a glutamate and/or lysine residue(s) for solubility (see e.g. Whitlow M et al., *Protein Engineering* 6: 989-95 (1993)).

Suitable linkers may be non-proteinaceous, such as, e.g. chemical linkers.

Suitable methods for linkage of the components of the cell-targeting molecules of the present invention may be by any method presently known in the art for accomplishing such, as long as the attachment does not substantially impede the binding capability of the cell-targeting binding region and/or when appropriate the desired Shiga toxin effector function(s) as measured by an appropriate assay, including assays described herein. For example, disulfide bonds and thioether bonds may be used to link two or more proteinaceous components of a cell-targeting molecule of the present invention.

For the purposes of the cell-targeting molecules of the present invention, the specific order or orientation is not fixed for the components unless stipulated. The arrangement of the Shiga toxin effector polypeptide(s), heterologous, CD8+ T-cell epitope cargo(s), the binding region(s), and any optional linker(s), in relation to each other or the entire cell-targeting molecule is not fixed (see e.g. FIG. 1) unless specifically noted. In general, the components of the cell-targeting molecules of the present invention may be arranged in any order provided that the desired activity(ies) of the binding region, Shiga toxin effector polypeptide, and heterologous, CD8+ T-cell epitope are not eliminated.

II. Examples of Specific Structural Variations of the Cell-Targeting Molecules of the Present Invention The cell-targeting molecules of the present invention comprise a Shiga toxin A Subunit effector polypeptide, a cell-targeting binding region, and a heterologous, CD8+ T-cell epitope-peptide cargo which is not embedded or inserted in the Shiga toxin A1 fragment region and/or the Shiga toxin A Subunit effector polypeptide. A cell-targeting molecule with the ability to deliver a CD8+ T-cell epitope cargo to the MHC class I presentation pathway of a target cell may be created, in principle, by linking any heterologous, CD8+ T-cell epitope-peptide to any combination of cell-targeting binding region and Shiga toxin A Subunit effector polypeptide as long as the resulting cell-targeting molecule has a cellular internalization capability (such as, e.g., via endocytosis) provided by at least the Shiga toxin effector, the cell-targeting moiety, or the structural combination of them together, and as long as the Shiga toxin effector polypeptide component or the cell-targeting molecule structure as a whole, provides, once inside a target cell, sufficient subcellular routing to a subcellular compartment competent for delivery of the T-cell epitope-peptide to the MHC class I presentation pathway of the target cell, such as, e.g., to the cytosol or the endoplasmic reticulum (ER).

The cell-targeting molecules of the present invention each comprise at least one Shiga toxin A Subunit effector polypeptide derived from at least one A Subunit of a member of the Shiga toxin family. In certain embodiments, the Shiga toxin effector polypeptide of the cell-targeting molecule of the present invention comprises or consists essentially of a truncated Shiga toxin A Subunit. Truncations of Shiga toxin A Subunits might result in the deletion of an entire epitope(s) and/or epitope region(s), B-cell epitopes, CD4+ T-cell epitopes, and/or furin-cleavage sites without affecting Shiga toxin effector functions, such as, e.g., catalytic activity and cytotoxicity. The smallest Shiga toxin A Subunit fragment shown to exhibit full enzymatic activity was a polypeptide composed of residues 1-239 of Slt1A (LaPointe P et al., *J Biol Chem* 280: 23310-18 (2005)). The smallest Shiga toxin A Subunit fragment shown to exhibit significant enzymatic activity was a polypeptide composed of residues 75-247 of StxA (Al-Jaufy A et al., *Infect Immun* 62: 956-60 (1994)).

Although Shiga toxin effector polypeptides of the present invention may commonly be smaller than the full-length Shiga toxin A Subunit, the Shiga toxin effector polypeptide of a cell-targeting molecule of the present invention may need to maintain the polypeptide region from amino acid position 77 to 239 (SLT-1A (SEQ ID NO:1) or StxA (SEQ ID NO:2)) or the equivalent in other A Subunits of members of the Shiga toxin family (e.g. 77 to 238 of (SEQ ID NOs: 3 and 7-18)). For example, in certain embodiments of the molecules of the present invention, the Shiga toxin effector polypeptides of the present invention derived from a Shiga toxin may comprise or consist essentially of the polypeptide represented by the amino acid sequence selected from amino acids 75 to 251, 1 to 241, 1 to 251, and 1 to 261 of any one of SEQ ID NOs: 1-2 and 4-6. Similarly, Shiga toxin effector polypeptides derived from a Shiga toxin 2 may comprise or consist essentially of the polypeptide represented by the amino acid sequence selected from amino acids 75 to 250, 1 to 241, 1 to 250, and 1 to 260 of any one of SEQ ID NOs: 3 and 7-18.

Although derived from a wild-type Shiga toxin A Subunit polypeptide, for certain embodiments of the molecules of the present invention, the Shiga toxin effector polypeptide differs from a naturally occurring Shiga toxin A Subunit by up to 1, 2, 3, 4, 5, 6, 7, 8, 9, 10, 15, 20, 25, 30, 35, 40 or more amino acid residues (but by no more than that which retains at least 85%, 90%, 95%, 99%, or more amino acid sequence identity).

The invention further provides variants of the cell-targeting molecules of the present invention, wherein the Shiga toxin effector polypeptide differs from a naturally occurring Shiga toxin A Subunit by only or up to 1, 2, 3, 4, 5, 6, 7, 8, 9, 10, 15, 20, 25, 30, 35, 40 or more amino acid residues (but by no more than that which retains at least 85%, 90%, 95%, 99% or more amino acid sequence identity). Thus, a molecule of the present invention derived from an A Subunit of a member of the Shiga toxin family may comprise additions, deletions, truncations, or other alterations from the original sequence as long as at least 85%, 90%, 95%, 99% or more amino acid sequence identity is maintained to a naturally occurring Shiga toxin A Subunit, such as, e.g., wherein there is a disrupted, furin-cleavage motif at the carboxy terminus of a Shiga toxin A1 fragment derived region.

Accordingly, in certain embodiments, the Shiga toxin effector polypeptide of a molecule of the present invention comprises or consists essentially of amino acid sequences having at least 55%, 60%, 65%, 70%, 75%, 80%, 85%, 90%, 95%, 97%, 98%, 99%, 99.5% or 99.7% overall sequence identity to a naturally occurring Shiga toxin A Subunit (e.g., any one of SEQ ID NOs: 1-18), such as, e.g., wherein there is a disrupted, furin-cleavage motif at the carboxy terminus of a Shiga toxin A1 fragment derived region.

Optionally, either a full-length or a truncated version of the Shiga toxin effector polypeptide of a cell-targeting molecule of the present of invention, wherein the Shiga toxin derived polypeptide comprises one or more mutations (e.g. substitutions, deletions, insertions, or inversions) as compared to a naturally occurring Shiga toxin A Subunit. It is preferred in certain embodiments of the invention that the Shiga toxin effector polypeptides have sufficient sequence identity to a wild-type Shiga toxin A Subunit to retain cytotoxicity after entry into a cell, either by well-known methods of host cell transformation, transfection, infection or induction, or by internalization mediated by a cell-targeting binding region linked with the Shiga toxin effector polypeptide. The most critical region of a Shiga toxin A Subunit for enzymatic activity is the active site, which is positioned around amino acid residues 137/138 to 209/210, depending on the variant, such as any one of SEQ ID NOs: 1-18. The most critical residues for enzymatic activity and/or cytotoxicity in the Shiga toxin A Subunits have been mapped to the following residue-positions: asparagine-75, tyrosine-77, glutamate-167, arginine-170, and arginine-176 among others (Di R et al., *Toxicon* 57: 525-39 (2011)). In any one of the embodiments of the invention, the Shiga toxin effector polypeptides may preferably but not necessarily maintain one or more conserved amino acids at positions, such as those found at positions 77, 167, 170, and 176 in StxA, SLT-1A, or the equivalent conserved position in other members of the Shiga toxin family which are typically required for potent cytotoxic activity. The capacity of a cytotoxic cell-targeting molecule of the present invention to cause cell death, e.g. its cytotoxicity, may be measured using any one or more of a number of assays well known in the art.

It should be noted that cell-targeting molecules of the invention that comprise Shiga toxin effector polypeptides with even considerable reductions in the Shiga toxin effector function(s) of subcellular routing as compared to wild-type Shiga toxin effector polypeptides may still be capable of delivering their heterologous, CD8+ T-cell epitope-peptide cargos to the MHC class I presentation pathway of a target cell, such as, e.g., in sufficient quantities to induce an immune response involving intercellular engagement of a CD8+ immune cell and/or to detect certain subcellular compartments of specific cell-types as even presentation of a single pMHC I complex is sufficient for intercellular engagement of a presenting cell by a CTL for cytolysis (Sykulev Y et al., *Immunity* 4: 565-71 (1996)).

In certain embodiments of the cell-targeting molecule of the present invention, the Shiga toxin effector polypeptide comprises (1) a Shiga toxin A1 fragment derived polypeptide having a carboxy-terminus and (2) a disrupted furin-cleavage motif at the carboxy-terminus of the Shiga toxin A1 fragment derived polypeptide. The carboxy-terminus of a Shiga toxin A1 fragment derived polypeptide may be identified by the skilled worker by using techniques known in the art, such as, e.g., by using protein sequence alignment software to identify (i) a furin-cleavage motif conserved with a naturally occurring Shiga toxin, (ii) a surface exposed, extended loop conserved with a naturally occurring Shiga toxin, and/or (iii) a stretch of amino acid residues which are predominantly hydrophobic (i.e. a hydrophobic "patch") that may be recognized by the ERAD system.

The Shiga toxin effector polypeptide of the cell-targeting molecule of the present invention (1) may completely lack any furin-cleavage motif at a carboxy-terminus of its Shiga toxin A1 fragment region and/or (2) comprise a disrupted furin-cleavage motif at the carboxy-terminus of its Shiga toxin A1 fragment region and/or region derived from the carboxy-terminus of a Shiga toxin A1 fragment. A disruption of a furin-cleavage motif includes various alterations to an amino acid residue in the furin-cleavage motif, such as, e.g., a post-translation modification(s), an alteration of one or more atoms in an amino acid functional group, the addition of one or more atoms to an amino acid functional group, the association to a non-proteinaceous moiety(ies), and/or the linkage to an amino acid residue, peptide, polypeptide such as resulting in a branched proteinaceous structure. For example, the linkage of a heterologous, CD8+ T-cell epitope-peptide cargo to the carboxy-terminus of the Shiga toxin A1 fragment region of a wild-type Shiga toxin effector polypeptide may result in reduced furin-cleavage of the Shiga toxin effector polypeptide as compared to a reference molecule lacking the linked epitope-peptide cargo.

Protease-cleavage resistant, Shiga toxin effector polypeptides may be created from a Shiga toxin effector polypeptide and/or Shiga toxin A Subunit polypeptide, whether naturally occurring or not, using a method described herein, described in WO 2015/191764, and/or known to the skilled worker, wherein the resulting molecule still retains one or more Shiga toxin A Subunit functions.

For purposes of the present invention with regard to a furin-cleavage site or furin-cleavage motif, the term "disruption" or "disrupted" refers to an alteration from the naturally occurring furin-cleavage site and/or furin-cleavage motif, such as, e.g., a mutation, that results in a reduction in furin-cleavage proximal to the carboxy-terminus of a Shiga toxin A1 fragment region, or identifiable region derived thereof, as compared to the furin-cleavage of a wild-type Shiga toxin A Subunit or a polypeptide derived from a wild-type Shiga toxin A Subunit comprising only wild-type polypeptide sequences. An alteration to an amino acid residue in the furin-cleavage motif includes a mutation in the furin-cleavage motif, such as, e.g., a deletion, insertion, inversion, substitution, and/or carboxy-terminal truncation of the furin-cleavage motif, as well as a post-translation modification, such as, e.g., as a result of glycosylation, albumination, and the like which involve conjugating or linking a molecule to the functional group of an amino acid residue. Because the furin-cleavage motif is comprised of about twenty, amino acid residues, in theory, alterations, modifications, mutations, deletions, insertions, and/or truncations involving one or more amino acid residues of any one of these twenty positions might result in a reduction of furin-cleavage sensitivity (Tian S et al., *Sci Rep* 2: 261 (2012)).

For purposes of the present invention, a "disrupted furin-cleavage motif" is furin-cleavage motif comprising an alteration to one or more amino acid residues derived from the 20 amino acid residue region representing a conserved, furin-cleavage motif found in native, Shiga toxin A Subunits at the junction between the Shiga toxin A1 fragment and A2 fragment regions and positioned such that furin cleavage of a Shiga toxin A Subunit results in the production of the A1 and A2 fragments; wherein the disrupted furin-cleavage motif exhibits reduced furin cleavage in an experimentally reproducible way as compared to a reference molecule comprising a wild-type, Shiga toxin A1 fragment region fused to a carboxy-terminal polypeptide of a size large enough to monitor furin cleavage using the appropriate assay known to the skilled worker and/or described herein.

Examples of types of mutations which can disrupt a furin-cleavage site and furin-cleavage motif are amino acid residue deletions, insertions, truncations, inversions, and/or substitutions, including substitutions with non-standard amino acids and/or non-natural amino acids. In addition, furin-cleavage sites and furin-cleavage motifs can be disrupted by mutations comprising the modification of an amino acid by the addition of a covalently-linked structure which masks at least one amino acid in the site or motif, such as, e.g., as a result of PEGylation, the coupling of small molecule adjuvants, and/or site-specific albumination.

If a furin-cleavage motif has been disrupted by mutation and/or the presence of non-natural amino acid residues, certain disrupted furin-cleavage motifs may not be easily recognizable as being related to any furin-cleavage motif; however, the carboxy-terminus of the Shiga toxin A1 fragment derived region will be recognizable and will define where the furin-cleavage motif would be located were it not disrupted. For example, a disrupted furin-cleavage motif may comprise less than the twenty, amino acid residues of the furin-cleavage motif due to a carboxy-terminal truncation as compared to a Shiga toxin A Subunit and/or Shiga toxin A1 fragment.

In certain embodiments of the cell-targeting molecule of the present invention, the Shiga toxin effector polypeptide comprises (1) a Shiga toxin A1 fragment derived polypeptide having a carboxy-terminus and (2) a disrupted furin-cleavage motif at the carboxy-terminus of the Shiga toxin A1 fragment polypeptide region; wherein the cell-targeting molecule is more furin-cleavage resistant as compared to a reference molecule, such as, e.g., a related molecule comprising only a wild-type Shiga toxin polypeptide component(s) or only a Shiga toxin effector polypeptide component(s) having a conserved, furin-cleavage motif between A1 and A2 fragments. For example, a reduction in furin cleavage of one molecule compared to a reference molecule may be determined using an in vitro, furin-cleavage assay described in WO 2015/191764, conducted using the same conditions, and then performing a quantitation of the band density of any fragments resulting from cleavage to quantitatively measure in change in furin cleavage.

In general, the protease-cleavage sensitivity of a cell-targeting molecule of the present invention is tested by comparing it to the same molecule having its furin-cleavage resistant, Shiga toxin effector polypeptide component(s) replaced with a wild-type, Shiga toxin effector polypeptide component(s) comprising a Shiga toxin A1 fragment. In certain embodiments, the molecules of the present invention comprising a disrupted furin-cleavage motif exhibit a reduction in in vitro furin cleavage of 30%, 40%, 50%, 60%, 70%, 80%, 90%, 95%, 97%, 98% or greater compared to a reference molecule comprising a wild-type, Shiga toxin A1 fragment fused at its carboxy-terminus to a peptide or polypeptide.

In certain embodiments of the cell-targeting molecules of the present invention, the Shiga toxin effector polypeptide comprises a disruption in one or more amino acids derived from the conserved, highly accessible, protease-cleavage sensitive loop of Shiga toxin A Subunits. In certain further embodiments, the Shiga toxin effector polypeptide comprising a disrupted furin-cleavage motif comprising a mutation in the surface-exposed, protease sensitive loop conserved among Shiga toxin A Subunits. In certain further embodiments, the mutation reduces the surface accessibility of certain amino acid residues within the loop such that furin-cleavage sensitivity is reduced.

In certain embodiments, the disrupted furin-cleavage motif of a Shiga toxin effector polypeptide of a cell-targeting molecule of the present invention comprises a disruption in terms of existence, position, or functional group of one or both of the consensus amino acid residues P1 and P4, such as, e.g., the amino acid residues in positions 1 and 4 of the minimal furin-cleavage motif R/Y-x-x-R. For example, mutating one or both of the two arginine residues in the minimal, furin consensus site R-x-x-R to alanine will disrupt a furin-cleavage motif by reducing or abolishing furin-cleavage at that site. For example, mutating one or both arginine residues to histidine will cause reduction in furin cleavage. Similarly, amino acid residue substitutions of one or both of the arginine residues in the minimal furin-cleavage motif R-x-x-R to any non-conservative amino acid residue known to the skilled worker will reduced the furin-cleavage sensitivity of the motif. In particular, amino acid residue substitutions of arginine to any non-basic amino acid residue which lacks a positive charge, such as, e.g., A, G, P, S, T, D, E, Q, N, C, I, L, M, V, F, W, and Y, will result in a disrupted furin-cleavage motif.

In certain embodiments, the disrupted furin-cleavage motif of a Shiga toxin effector polypeptide of the present invention comprises a disruption in the spacing between the consensus amino acid residues P4 and P1 in terms of the number of intervening amino acid residues being other than two, and, thus, changing either P4 and/or P1 into a different position and eliminating the P4 and/or P1 designations. For example, deletions within the furin-cleavage motif of the minimal furin-cleavage site or the core, furin-cleavage motif will reduce the furin-cleavage sensitivity of the furin-cleavage motif.

In certain embodiments of the cell-targeting molecules of the present invention, the disrupted furin-cleavage motif comprises one or more amino acid residue substitutions, as compared to a wild-type, Shiga toxin A Subunit. In certain further embodiments, the disrupted furin-cleavage motif comprises one or more amino acid residue substitutions within the minimal furin-cleavage site R/Y-x-x-R, such as, e.g., for StxA and SLT-1A derived Shiga toxin effector polypeptides, the natively positioned amino acid residue R248 substituted with any non-positively charged, amino acid residue and/or R251 substituted with any non-positively charged, amino acid residue; and for SLT-2A derived Shiga toxin effector polypeptides, the natively positioned amino acid residue Y247 substituted with any non-positively charged, amino acid residue and/or R250 substituted with any non-positively charged, amino acid residue.

In certain embodiments of the cell-targeting molecules of the present invention, the disrupted furin-cleavage motif comprises an un-disrupted, minimal furin-cleavage site R/Y-x-x-R but instead comprises a disrupted flanking region, such as, e.g., amino acid residue substitutions in one or more amino acid residues in the furin-cleavage motif flanking regions natively position at, e.g., 241-247 and/or 252-259. In certain further embodiments, the disrupted furin cleavage motif comprises a substitution of one or more of the amino acid residues located in the P1-P6 region of the furin-cleavage motif; mutating P1' to a bulky amino acid, such as, e.g., R, W, Y, F, and H; and mutating P2' to a polar and hydrophilic amino acid residue; and substituting one or more of the amino acid residues located in the P1'-P6' region of the furin-cleavage motif with one or more bulky and hydrophobic amino acid residues In certain embodiments of the cell-targeting molecules of the present invention, the disrupted furin-cleavage motif comprises a deletion, insertion, inversion, and/or substitution of at least one amino acid residue within the furin-cleavage motif relative to a wild-type Shiga toxin A Subunit. In certain further embodiments, the disrupted furin-cleavage motif comprises a disruption of the amino acid sequence natively positioned at 248-251 of the A Subunit of Shiga toxin (SEQ ID NOs: 1-2 and 4-6), at 247-250 of the A Subunit of Shiga-like toxin 2 (SEQ ID NOs: 3 and 7-18), or at the equivalent position in a conserved Shiga toxin effector polypeptide and/or non-native Shiga toxin effector polypeptide sequence. In certain further embodiments, the disrupted furin-cleavage motif comprises a disruption which comprises a mutation, such as, e.g., an amino acid substitution to a non-standard amino acid or an amino acid with a chemically modified side chain. In certain further embodiments, the disrupted furin-cleavage motif comprises comprise a disruption which comprises a deletion of at least one amino acid within the furin-cleavage motif. In certain further embodiments, the disrupted furin-cleavage motif comprises the deletion of nine, ten, eleven, or more of the carboxy-terminal amino acid residues within the furin-cleavage motif. In these embodiments, the disrupted furin-cleavage motif will not comprise a furin-cleavage site or a minimal furin-cleavage motif. In other words, certain embodiments lack a furin-cleavage site at the carboxy-terminus of the A1 fragment region.

In certain embodiments of the cell-targeting molecules of the present invention, the disrupted furin-cleavage motif comprises an amino acid residue deletion and an amino acid residue substitution as well as a carboxy-terminal truncation as compared to a wild-type, Shiga toxin A Subunit. In certain further embodiments, the disrupted furin-cleavage motif comprises one or more amino acid residue deletions and substitutions within the minimal furin-cleavage site R/Y-x-x-R.

In certain embodiments of the cell-targeting molecules of the present invention, the disrupted furin-cleavage motif comprises both an amino acid substitution within the minimal furin-cleavage site R/Y-x-x-R and a carboxy-terminal truncation as compared to a wild-type, Shiga toxin A Subunit, such as, e.g., for StxA and SLT-1A derived Shiga toxin effector polypeptides, truncations ending at the natively amino acid position 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, or greater and comprising the natively positioned amino acid residue R248 and/or R251 substituted with any non-positively charged, amino acid residue where appropriate; and for SLT-2A derived Shiga toxin effector polypeptides, truncations ending at the natively amino acid position 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, or greater and comprising the natively positioned amino acid residue Y247 and/or R250 substituted with any non-positively charged, amino acid residue where appropriate.

In certain embodiments of the cell-targeting molecules of the present invention, the disrupted furin-cleavage motif comprises both an amino acid residue deletion and an amino acid residue substitution as compared to a wild-type, Shiga toxin A Subunit. In certain further embodiments, the disrupted furin-cleavage motif comprises one or more amino acid residue deletions and substitutions within the minimal furin-cleavage site R/Y-x-x-R.

In certain embodiments of the cell-targeting molecule of the present invention, the disrupted furin-cleavage motif comprises an amino acid residue deletion, an amino acid residue insertion, an amino acid residue substitution and/or a carboxy-terminal truncation as compared to a wild-type, Shiga toxin A Subunit.

The cell-targeting molecules of the present invention each comprise one or more, heterologous, CD8+ T-cell epitope-peptide cargos which is not embedded or inserted in the Shiga toxin A1 fragment region of any Shiga toxin effector polypeptide component. In certain embodiments, the CD8+ T-cell epitope-peptide is an antigenic and/or immunogenic epitope in a human. In certain embodiments, the CD8+ T-cell epitope-peptide component of the cell-targeting molecules of the present invention comprises or consists essentially of an 8-11 amino acid long peptide derived from a molecule of a microbial pathogen which infects humans, such as, e.g., an antigen from a virus that infects humans. In certain further embodiments, the CD8+ T-cell epitope-peptide component of the cell-targeting molecules of the invention comprises or consists essentially of any one of the peptides shown in SEQ ID NOs: 19-28.

In certain embodiments of the cell-targeting molecules of the present invention, the heterologous, CD8+ T-cell epitope-peptide cargo is linked to the cell-targeting molecule via a thiol linkage, such as, e.g., disulfide bond. In certain further embodiments, the thiol linkage is a cysteine to cysteine disulfide bond.

In certain embodiments of the cell-targeting molecules of the present invention, the heterologous, CD8+ T-cell epitope-peptide cargo is linked to the cell-targeting molecule via a disulfide bond involving the functional group of a cysteine residue of a Shiga toxin effector polypeptide component of the cell-targeting molecule, such as, e.g., C241 of SLT-2A (SEQ ID NO:3) or 242 of StxA (SEQ ID NO:2) or SLT-1A (SEQ ID NO:1). In certain further embodiments, the cysteine residue is positioned carboxy-terminal to the carboxy terminus of the Shiga toxin A1 fragment region of the Shiga toxin effector polypeptide (e.g., the cysteine residue C260 of SLT-2A (SEQ ID NO:3) or C261 of StxA (SEQ ID NO:2) or SLT-1A (SEQ ID NO:1)).

The cell-targeting molecules of the present invention comprise at least one cell-targeting binding region. Among certain embodiments of the cell-targeting molecules of the present invention, the binding region is derived from an immunoglobulin-type polypeptide selected for specific and high-affinity binding to a surface antigen on the cell surface of a cancer or tumor cell, where the antigen is restricted in expression to cancer or tumor cells (see Glokler J et al., *Molecules* 15: 2478-90 (2010); Liu Y et al., *Lab Chip* 9: 1033-6 (2009). In accordance with other embodiments, the binding region is selected for specific and high-affinity binding to a surface antigen on the cell surface of a cancer cell, where the antigen is over-expressed or preferentially expressed by cancer cells as compared to non-cancer cells. Some representative target biomolecules include, but are not limited to, the following enumerated targets associated with cancers and/or specific immune cell-types.

Many immunoglobulin-type binding regions that bind with high affinity to extracellular epitopes associated with cancer cells are known to the skilled worker, such as binding regions that bind any one of the following target biomolecules: annexin AI, B3 melanoma antigen, B4 melanoma antigen, CD2, CD3, CD4, CD19, CD20 (B-lymphocyte antigen protein CD20), CD22, CD25 (interleukin-2 receptor IL2R), CD30 (TNFRSF8), CD37, CD38 (cyclic ADP ribose hydrolase), CD40, CD44 (hyaluronan receptor), ITGAV (CD51), CD56, CD66, CD70, CD71 (transferrin receptor), CD73, CD74 (HLA-DR antigens-associated invariant chain), CD79, CD98, endoglin (END, CD105), CD106 (VCAM-1), CD138, chemokine receptor type 4 (CDCR-4, fusin, CD184), CD200, insulin-like growth factor 1 receptor (CD221), mucin1 (MUC1, CD227, CA6, CanAg), basal cell adhesion molecule (B-CAM, CD239), CD248 (endosialin, TEM1), tumor necrosis factor receptor 10b (TNFRSF10B, CD262), tumor necrosis factor receptor 13B (TNFRSF13B, TACI, CD276), vascular endothelial growth factor receptor 2 (KDR, CD309), epithelial cell adhesion molecule (EpCAM, CD326), human epidermal growth factor receptor 2 (HER2, Neu, ErbB2, CD340), cancer antigen 15-3 (CA15-3), cancer antigen 19-9 (CA 19-9), cancer antigen 125 (CA125, MUC16), CA242, carcinoembryonic antigen-related cell adhesion molecules (e.g. CEACAM3 (CD66d) and CEACAM5), carcinoembryonic antigen protein (CEA), choline transporter-like protein 4 (SLC44A4), chondroitin sulfate proteoglycan 4 (CSP4, MCSP, NG2), CTLA4, delta-like proteins (e.g. DLL3, DLL4), ectonucleotide pyrophosphatase/phosphodiesterase proteins (e.g. ENPP3), endothelin receptors (ETBRs), epidermal growth factor receptor (EGFR, ErbB1), folate receptors (FOLRs, e.g. FRα), G-28, ganglioside GD2, ganglioside GD3, HLA-Dr10, HLA-DRB, human epidermal growth factor receptor 1 (HER1), HER3/ErbB-3, Ephrin type-B receptor 2 (EphB2), epithelial cell adhesion molecule (EpCAM), fibroblast activation protein (FAP/seprase), guanylyl cyclase c (GCC), insulin-like growth factor 1 receptor (IGF1R), interleukin 2 receptor (IL-2R), interleukin 6 receptor (IL-6R), integrins alpha-V beta-3 ($\alpha_V\beta_3$), integrins alpha-V beta-5 ($\alpha v\beta 5$), integrins alpha-5 beta-1 ($\alpha_5\beta_1$), L6, zinc transporter (LIV-1), MPG, melanoma-associated antigen 1 protein (MAGE-1), melanoma-associated antigen 3 (MAGE-3), mesothelin (MSLN), metalloreductase STEAP1, MPG, MS4A, NaPi2b, nectins (e.g. nectin-4), p21, p97, polio virus receptor-like 4 (PVRL4), protease-activated-receptors (such as PAR1), prostate-specific membrane antigen proteins (PSMAs), SLIT and NTRK-like proteins (e.g. SLITRK6), Thomas-Friedenreich antigen, transmembrane glycoprotein (GPNMB), trophoblast glycoproteins (TPGB, 5T4, WAIF1), and tumor-associated calcium signal transducers (TAC-STDs, e.g. Trop-2, EGP-1, etc.) (see e.g. Lui B et al., *Cancer Res* 64: 704-10 (2004); Novellino L et al., *Cancer Immunol Immunother* 54: 187-207 (2005); Bagley R et al., *Int J Oncol* 34: 619-27 (2009); Gerber H et al., *mAbs* 1: 247-53 (2009); Beck A et al., *Nat Rev Immunol* 10: 345-52 (2010); Andersen J et al., *J Biol Chem* 287: 22927-37 (2012); Nolan-Stevaux O et al., *PLoS One* 7: e50920 (2012); Rust S et al., *Mol Cancer* 12: 11 (2013)). This list of target biomolecules is intended to be non-limiting. It will be appreciated by the skilled worker that any desired target biomolecule associated with a cancer cell or other desired cell-type may be used to design or select a binding region which may be suitable for use as a component of a cell-targeting molecule of the present invention.

Examples of other target biomolecules which are strongly associated with cancer cells and are bound with high-affinity by a known immunoglobulin-type binding region include BAGE proteins (B melanoma antigens), basal cell adhesion molecules (BCAMs or Lutheran blood group glycoproteins), bladder tumor antigen (BTA), SAIL (C16orf54), cancer-testis antigen NY-ESO-1, cancer-testis antigen LAGE proteins, CD19 (B-lymphocyte antigen protein CD19), CD21 (complement receptor-2 or complement 3d receptor), CD26 (dipeptidyl peptidase-4, DPP4, or adenosine deaminase complexing protein 2), CD33 (sialic acid-binding immunoglobulin-type lectin-3), CD52 (CAMPATH-1 antigen), CD56, CS1 (SLAM family number 7 or SLAMF7), cell surface A33 antigen protein (gpA33), Epstein-Barr virus antigen proteins, GAGFPAGE proteins (melanoma associated cancer/testis antigens), hepatocyte growth factor receptor (HGFR or c-Met), MAGE proteins, melanoma antigen recognized by T-cells 1 protein (MART-1/MelanA, MARTI), mucins, Preferentially Expressed Antigen of Melanoma (PRAME) proteins, prostate specific antigen protein (PSA), prostate stem cell antigen protein (PSCA), Receptor for Advanced Glycation Endroducts (RAGE), tumor-associated glycoprotein 72 (TAG-72), vascular endothelial growth factor receptors (VEGFRs), and Wilms' tumor antigen.

Examples of other target biomolecules which are strongly associated with cancer cells are carbonic anhydrase IX (CA9/CAIX), claudin proteins (CLDN3, CLDN4), ephrin type-A receptor 3 (EphA3), folate binding proteins (FBP), ganglioside GM2, insulin-like growth factor receptors, integrins (such as CD11a-c), receptor activator of nuclear factor kappa B (RANK), receptor tyrosine-protein kinase erB-3, tumor necrosis factor receptor 10A (TRAIL-R1/DR4), tumor necrosis factor receptor 10B (TRAIL-R2), tenascin C, and CD64 (FcγRI) (see Hough C et al., *Cancer Res* 60: 6281-7 (2000); Thepen T et al., *Nat Biotechnol* 18: 48-51 (2000); Pastan I et al., *Nat Rev Cancer* 6: 559-65 (2006); Pastan, *Annu Rev Med* 58: 221-37 (2007); Fitzgerald D et al., *Cancer Res* 71: 6300-9 (2011); Scott A et al., *Cancer Immun* 12: 14-22 (2012)). This list of target biomolecules is intended to be non-limiting.

In addition, there are numerous other examples of contemplated, target biomolecules, such as, e.g., ADAM metalloproteinases (e.g. ADAM-9, ADAM-10, ADAM-12, ADAM-15, ADAM-17), ADP-ribosyltransferases (ART1, ART4), antigen F4/80, bone marrow stroma antigens (BST1, BST2), break point cluster region-c-abl oncogene (BCR-ABL) proteins, C3aR (complement component 3a receptors), CD7, CD13, CD14, CD15 (Lewis X or stage-specific embryonic antigen 1), CD23 (FC epsilon RII), CD45 (protein tyrosine phosphatase receptor type C), CD49d, CD53, CD54 (intercellular adhesion molecule 1), CD63 (tetraspanin), CD69, CD80, CD86, CD88 (complement component 5a receptor 1), CD115 (colony stimulating factor 1 receptor), IL-1R (interleukin-1 receptor), CD123 (interleukin-3 receptor), CD129 (interleukin 9 receptor), CD183 (chemokine receptor CXCR3), CD191 (CCR1), CD193 (CCR3), CD195 (chemokine receptor CCR5), CD203c, CD225 (interferon-induced transmembrane protein 1), CD244 (Natural Killer Cell Receptor 2B4), CD282 (Toll-like receptor 2), CD284 (Toll-like receptor 4), CD294 (GPR44), CD305 (leukocyte-associated immunoglobulin-like receptor 1), ephrin type-A receptor 2 (EphA2), FceRIa, galectin-9, alpha-fetoprotein antigen 17-A1 protein, human aspartyl (asparaginyl) beta-hydroxylase (HAAH), immunoglobulin-like transcript ILT-3, lysophosphatidlglycerol acyltransferase 1 (LPGAT1/IAA0205), lysosome-associated membrane proteins (LAMPs, such as CD107), melanocyte protein PMEL (gp100), myeloid-related protein-14 (mrp-14), NKG2D ligands (e.g., MICA, MICB, ULBP1, ULBP2, UL-16-binding proteins, H-60s, Rae-1s, and homologs thereof), receptor tyrosine-protein kinase erbB-3, SART proteins, scavenger receptors (such as CD64 and CD68), Siglecs (sialic acid-binding immunoglobulin-type lectins), syndecans (such as SDC1 or CD138), tyrosinase, tyrosinease-related protein 1 (TRP-1), tyrosinease-related protein 2 (TRP-2), tyrosinase associated antigen (TAA), APO-3, BCMA, CD2, CD3, CD4, CD8, CD18, CD27, CD28, CD29, CD41, CD49, CD90, CD95 (Fas), CD103, CD104, CD134 (OX40), CD137 (4-1BB), CD152 (CTLA-4), chemokine receptors, complement proteins, cytokine receptors, histocompatibility proteins, ICOS, interferon-alpha, interferon-beta, c-myc, osteoprotegerin, PD-1, RANK, TACI, TNF receptor superfamily member (TNF-R1, TNFR-2), Apo2/TRAIL-R1, TRAIL-R2, TRAIL-R3, and TRAIL-R4 (see Scott A et al., *Cancer Immunity* 12: 14 (2012); Cheever M et al., *Clin Cancer Res* 15: 5323-37 (2009)), for target biomolecules and note the target biomolecules described therein are non-limiting examples).

In certain embodiments, the binding region comprises or consists essentially of an immunoglobulin-type binding region capable of specifically binding with high-affinity to the cellular surface of a cell-type of the immune system. For example, immunoglobulin-type binding domains are known which bind to immune cell surface factors, such as, e.g., CD1, CD2, CD3, CD4, CD5, CD6, CD7, CD8, CD9, CD10, CD11, CD12, CD13, CD14, CD15, CD16, CD17, CD18, CD19, CD20, CD21, CD22, CD23, CD24, CD25, CD26, CD27, CD28, CD29, CD30, CD31, CD33, CD34, CD35, CD36, CD37, CD38, CD40, CD41, CD56, CD61, CD62, CD66, CD95, CD117, CD123, CD235, CD146, CD326, interleukin-1 receptor (IL-1R), interleukin-2 receptor (IL-2R), receptor activator of nuclear factor kappa B (RANKL), SLAM-associated protein (SAP), and TNFSF18 (tumor necrosis factor ligand 18 or GITRL).

For further examples of target biomolecules and binding regions envisioned for use in the molecules of the present invention, see WO 2005/92917, WO 2007/033497, US2009/

156417, JP4339511, EP1727827, DE602004027168, EP1945660, JP4934761, EP2228383, US2013/196928, WO 2014/164623, WO 2014/164693, WO 2015/138435, WO 2015/138452, WO 2015/113005, WO 2015/113007, WO 2015/191764, US2015/259428, 62/168,758, 62/168,759, 62/168,760, 62/168,761, 62/168,762, 62/168,763, and PCT/US2016/016580.

Certain embodiments of the cell-targeting molecules of the present invention are cytotoxic, cell-targeting, fusion proteins. Certain further embodiments are the cell-targeting molecules which comprise or consist essentially of one of the polypeptides shown in SEQ ID NOs: 19-255 and 288-748. Certain further embodiments are the cell-targeting molecules which comprise or consist essentially of one of the polypeptides shown in SEQ ID NOs: 252-255 and 288-748.

In certain embodiments, the cell-targeting molecule of the present invention is a fusion protein, such as, e.g. immunotoxins or ligand-toxin fusion. Certain embodiments of the cell-targeting molecules of the present invention are reduced-cytotoxicity or non-cytotoxic, cell-targeting, fusion proteins. Certain embodiments are the cell-targeting molecules which comprise or consist essentially of one of the polypeptides shown in SEQ ID NOs: 252-255 and 288-748 which further comprises one or more amino acid substitutions in the Shiga toxin effector polypeptide component(s) altering the natively positioned residue selected from the group consisting of: A231E, N75A, Y77S, Y114S, E167D, R170A, R176K and/or W203A in SEQ ID NO:1, SEQ ID NO:2, or SEQ ID NO:3, or the equivalent amino acid residue in a Shiga toxin A Subunit. Certain further embodiments are the cell-targeting molecules which comprise or consist essentially of one of the polypeptides shown in SEQ ID NOs: 258, 260, 268, 270, and 278.

To alter the half-life of a cell-targeting molecule of the present invention after administration to a chordate, a polyethylene glycol molecule(s), an immunoglobulin Fc region(s), an immunoglobulin constant domain, an inactivated Fc region(s), and/or a salvage receptor binding epitope(s) may be incorporated into the molecule using standard techniques known to the skilled worker (see e.g. U.S. Pat. Nos. 5,739,277; 7,083,784; 7,348,004; US2008/422112; WO2010/033279; WO2013/012733; U.S. Pat. No. 9,790,268).

In certain embodiments of the cell-targeting molecule of the present invention, two or more binding regions, each capable of binding an extracellular part of the same target biomolecule, are associated with a Shiga toxin effector polypeptide(s) to produce multivalent cell-targeting molecules of the present invention.

In certain embodiments, the multivalent cell-targeting molecules of the present invention comprise 2, 3, 4, 5, 6, 7, 8, 9, 10, 11, 12, 13, 14, 15, 16, 17, 18, 19, 20, or 22 individual binding regions.

The multivalent cell-targeting molecules of the invention may comprise various multivalent structures. For example, multivalent structures can be created using covalent and/or non-covalent interactions to associate together various components to form a multivalent cell-targeting molecule of the present invention. In certain embodiments, the multivalent cell-targeting molecules of the present invention are multimeric complexes of two or more proteinaceous subunits, such as, e.g. dimers, trimers, tetramers, diabodies, triabodies, tetrabodies, etc.

In certain embodiments, the multivalent cell-targeting molecule of the present invention comprises two or more binding regions because two or more components of the multivalent cell-targeting molecule are chemically linked or conjugated together. For example, chemical linkers may be used to conjugate two or more target-binding proteins together to form a multivalent cell-targeting molecule (see e.g. Wolff E et al., *Cancer Res* 53: 2560-5 (1993); Ghetie M et al., *Proc Natl Acad Sci USA* 94: 7509-14 (1997); Ghetie M et al., *Blood* 97: 1392-8 (2001)).

Certain embodiments of the multivalent cell-targeting molecules of the present invention comprise a multimeric structure comprising two or more component molecules, which may be identical or non-identical. As used herein, the nomenclature $(X)_n$ refers to a molecule comprising or consisting of integer number (n) copies of a component (X). For example, a dimeric protein comprising two identical, monovalent, target-binding polypeptide subunits may be referred to as a homodimer or (target-binding monomer)$_2$. Another example is a mixture of multivalent proteins, each protein comprising three or more identical polypeptide "X" subunits, which is referred to herein as $(X)_{2+n}$, where "n" refers to a positive integer and the value of "2+n" representing the number of binding regions per protein of the protein molecules present, thus describing a plurality of different multivalent protein species present in a single protein composition.

Certain embodiments of the multivalent cell-targeting molecules of the present invention are multimeric, being comprised of two or more target-binding molecules, such as, e.g., homodimers, homotrimers, and homotetramers, and the like. For example, two or more monovalent target-binding polypeptides may be combined to form multivalent cell-targeting molecules of the present invention.

In certain embodiments, the multivalent cell-targeting molecule of the present invention comprises two or more components, each comprising at least one of the binding regions of the multivalent cell-targeting molecule, because of a non-covalent intermolecular association(s) resulting from domain swapping between the two or more components which results in a multivalent cell-targeting molecule with a multimeric structure (see e.g. FIG. 1B). For example, protein domain swapping between immunoglobulin domains can be engineered and optimized as a mechanism of producing precise multimeric structures (see e.g. Holliger P et al., *Proc Natl Acad Sci USA* 90: 6444-8 (1993); Arndt K et al., *Biochemistry* 37: 12918-26 (1998)).

The skilled worker can engineer multimeric, multivalent cell-targeting molecules of the present invention using various scFv-based polypeptide interactions, such as, e.g. scFv-based dimeric, trimeric, tetrameric complexes, etc. For example, the length of the linker in the scFv can affect the spontaneous assembly of non-covalent based, multimeric, multivalent structures. Generally, linkers of twelve amino acids or less, including the absence of any linker, promote the multimerization of polypeptides or proteins comprising scFvs into higher molecular weight species via favoring intermolecular domain swapping over intra-chain domain pairing (see e.g., Huston J et al., *Methods Enzymol* 203: 46-88 (1991); Holliger P et al., *Proc Natl Acad Sci USA* 90: 6444-8 (1993); Stemmer W et al., *Biotechniques* 14: 256-65 (1993); Whitlow M et al., *Protein Eng* 6: 989-95 (1993); Desplancq D et al., *Protein Eng* 7: 1027-33 (1994); Whitlow M et al., *Protein Eng* 7: 1017-26 (1994); Alfthan K et al., *Protein Eng* 8: 725-31 (1995); Iliades P et al., *FEBS Lett* 409: 437-41 (1997); Kortt A et al., *Biomol Eng* 18: 95-108 (2001); Todorovska A et al., *J Immunol Methods* 248: 47-66 (2001); Tomlinson I, Holliger P et al., *Methods Enzymol* 326: 461-79 (2001); Dolezal O et al., *Protein Eng* 16: 47-56 (2003)). However, scFvs with no linker at all or a linker with an exemplary length of 15 amino acid residues may multimerize (Whitlow M et al., *Protein Eng* 6: 989-95 (1993); Desplancq D et al., *Protein Eng* 7: 1027-33 (1994); Whitlow M et al., *Protein Eng* 7, 1017-26 (1994); Alfthan K et al., *Protein Eng* 8: 725-31 (1995)). The skilled worker can identify the multimeric structure(s) created and/or purified using techniques known in the art and/or described herein.

In addition, engineered structures with additional covalent bonds can be used to stabilize multimeric structures that spontaneously assemble (see e.g. Glockshuber R et al., *Biochemistry* 29: 1362-7 (1990)). For example, the introduction of cysteine residues at specific locations may be used to create disulfide-stabilized structures like Cys-diabodies, scFv' multimers, $V_HH$ multimers, $V_{NAR}$ multimers, and IgNAR multimers such as, e.g., by adding the following amino acid residues: GGGGC and SGGGGC (Tai M et al., *Biochemistry* 29: 8024-30 (1990); Caron P et al., *J Exp Med* 176: 1191-5 (1992); Shopes B, *J Immunol* 148: 2918-22 (1992); Adams G et al., *Cancer Res* 53: 4026-34 (1993); McCartney J et al., *Protein Eng* 18: 301-14 (1994); Perisic O et al., *Structure* 2: 1217-26 (1994); George A et al., *Proc Nat Acad Sci USA* 92: 8358-62 (1995); Tai M et al., *Cancer Res* (Suppl) 55: 5983-9 (1995); Olafsen T et al., *Protein Eng Des Sel* 17: 21-7 (2004)). Thus, the skilled worker can create or stabilize multivalent cell-targeting molecules of the present invention using disulfide bridge(s) and/or by adding or removing cysteine residue(s) at certain positions to control the position(s) of certain disulfide bridges.

In certain embodiments, the multivalent structure of a target-binding molecule of the present invention comprises two or more immunoglobulin domains that binding an extracellular part of the same target biomolecule. In certain embodiments, the multivalent cell-targeting molecule of the present invention may comprise or consist of a single, continuous, polypeptide chain. For example, single-chain bivalent scFvs, sometimes referred to as tandem scFvs (taFvs), single chain diabodies (scDbs), and tandem diabodies (tanDbs or Tandabs), represent multivalent binding proteins which are created from a single continuous polypeptide (see e.g. Mack M et al., *Proc Natl Acad Sci USA* 92: 7021-5 (1995); Kipriyanov S et al., *J Mol Biol* 293: 41-56 (1999); Cochlovius, B et al., *Cancer Res* 60: 4336-41 (2000); Völkel T et al., *Protein Eng* 14: 815-23 (2001); Jendreyko N et al., *J Biol Chem* 278: 47812-9 (2003); Kipriyanov S et al., *J Mol Biol* 330: 99-111 (2003); Miller K et al., *J Immunol* 170: 4854-61 (2003); Meng R et al., *Clin Cancer Res* 10: 1274-81 (2004); Schlereth B et al., *Cancer Res* 65: 2882-9 (2005); Huang T, Morrison S, *J Pharmacol Exp Ther* 316: 983-91 (2006); Liu X et al., *Int Immunopharmacol* 6: 791-9 (2006); Shen J et al., *J Biol Chem* 281: 10706-14 (2006); Shen J et al., *J Immunol Methods* 318: 65-74 (2007); Wu C et al., *Nat Biotech* 25: 1290-7 (2007); Li B et al., *Cancer Res* 68: 2400-8 (2008)).

In certain embodiments, the multivalent cell-targeting molecule of the present invention comprises both a linker(s) between two or more binding regions as well as one or more disulfide bonds between components of the binding regions, whether proximal or distal to the linker, such as a disulfide bond between two immunoglobulin regions which requires an immunoglobulin domain swapping association between those two immunoglobulin regions (see e.g. Glockshuber R et al., *Biochemistry.* 29: 1362-7 (1990)).

Alternatively, two or more polypeptide chains may be linked together using peptide and/or polypeptide domains which self-associate or multimerize with each other (see e.g. U.S. Pat. No. 6,329,507; Wang L et al., *Protein Eng Des Sel* 26: 417-23 (2013)). For example, the addition of carboxy-terminal multimerization domains has been used to construct multivalent proteins comprising immunoglobulin domains, such as, e.g., scFvs, autonomous $V_H$ domains, $V_HH$s, $V_{NAR}$s, and IgNARs. Examples of self-associating domains known to the skilled worker include immunoglobulin constant domains (such as knobs-into-holes, electrostatic steering, and IgG/IgA strand exchange), immunoglobulin Fab chains (e.g. (Fab-scFv)$_2$ and (Fab' scFv)$_2$), immunoglobulin Fc domains (e.g. (scDiabody-Fc)$_2$, (scFv-Fc)$_2$ and scFv-Fc-scFv), immunoglobulin CHX domains, immunoglobulin CH1-3 regions, immunoglobulin CH-3 domains (e.g. (sc-Diabody-CH3)$_2$, LD minibody, and Flex-minibody), immunoglobulin CH4 domains, CHCL domains, amphiphilic helix bundles (e.g. scFv-HLX), helix-turn-helix domains (e.g. scFv-dHlx), coiled-coil structures including leucine zippers and cartilage oligometric matrix proteins (e.g. scZIP), cAMP-dependent protein kinase (PKA) dimerization and docking domains (DDDs) combined with an A kinase anchor protein (AKAP) anchoring domain (AD) (also referred to as "dock-and-lock" or "DNL"), streptavidin, verotoxin B multimerization domains, tetramerization regions from p53, and barnase-barstar interaction domains (Pack P, Plückthun A, *Biochemistry* 31: 1579-84 (1992); Holliger P et al., *Proc Natl Acad Sci USA* 90: 6444-8 (1993); Kipriyanov S et al., *Hum Antibodies Hybridomas* 6: 93-101 (1995); de Kruif J, Logtenberg T, *J Biol Chem* 271: 7630-4 (1996); Hu S et al., *Cancer Res* 56: 3055-61 (1996); Kipriyanov S et al., *Protein Eng* 9: 203-11 (1996); Rheinnecker M et al., *J Immunol* 157: 2989-97 (1996); Tershkikh A et al., *Proc Natl Acad Sci USA* 94: 1663-8 (1997); Müller K et al., *FEBS Lett* 422: 259-64 (1998); Cloutier S et al., *Mol Immunol* 37: 1067-77 (2000); Li S et al., *Cancer Immunol Immunother* 49: 243-52 (2000); Schmiedl A et al., *Protein Eng* 13: 725-34 (2000); Schoonjans R et al., *J Immunol* 165: 7050-7 (2000); Borsi L et al., *Int J Cancer* 102: 75-85 (2002); Deyev S et al., *Nat Biotechnol* 21: 1486-92 (2003); Wong W, Scott J, *Nat Rev Mol Cell Biol* 5: 959-70 (2004); Zhang J et al., *J Mol Biol* 335: 49-56 (2004); Baillie G et al., *FEBS Letters* 579: 3264-70 (2005); Rossi E et al., *Proc Natl Acad Sci USA* 103: 6841-6 (2006); Simmons D et al., *J Immunol Methods* 315: 171-84 (2006); Braren I et al., *Biotechnol Appl Biochem* 47: 205-14 (2007); Chang C et al., *Clin Cancer Res* 13: 5586-91s (2007); Liu M et al., *Biochem J* 1406: 237-46 (2007); Zhang J et al., *Protein Expr Purif* 65: 77-82 (2009); Bell A et al., *Cancer Lett* 289: 81-90 (2010); Iqbal U et al., *Br J Pharmacol* 160: 1016-28 (2010); Asano R et al., *FEBS J* 280: 4816-26 (2013); Gil D, Schrum A, *Adv Biosci Biotechnol* 4: 73-84 (2013)).

In certain embodiments, the structure of a multivalent cell-targeting molecule of the present invention is engineered from an antibody or Fab fragment. For example, multivalent cell-targeting molecules may be engineered using approaches known to the skilled worker (see e.g. Shuford W et al., *Science* 252: 724-7 (1991); Caron P et al., *J Exp Med* 176: 1191-5 (1992); Shopes B, *J Immunol* 148: 2918-22 (1992); Wolff E et al., *Cancer Res* 53: 2560-5 (1993)).

In certain embodiments of the multivalent cell-targeting molecules of the present invention, all the cell-targeting binding regions of the multivalent cell-targeting molecules are identical and/or share the same binding specificities. In such embodiments, the multivalent cell-targeting molecule of the invention is monospecific—meaning it comprises binding regions that bind with high affinity to the same extracellular target biomolecule, overlapping extracellular epitopes in the same target biomolecule, and/or the same extracellular epitope in a target biomolecule. Whether two binding regions are binding to the same extracellular part of a target biomolecule may be determined by the skilled worker with available methods, such as, e.g., empirically using competitive binding assays or predictively based on the overlap of known epitope and/or immunized peptide sequences.

In certain embodiments, the multivalent cell-targeting molecule of the present invention may comprise binding regions that bind with high affinity to non-identical epitopes, whether non-overlapping or overlapping. The multivalent cell-targeting molecules of the present invention may comprise binding regions with high binding affinity to non-overlapping epitopes. Multispecific, multivalent cell-targeting molecules of the present invention may be created using two or more different binding regions, such as, e.g., two different scFvs, $V_H$Hs, $V_{NAR}$s, and/or IgNARs in diabodies, triabodies, tandem formats (including tandem di-scFv, tandem tri-scFv, and scFv-Fc tandems), single-chain diabodies (scDb), tandem Fvs, bispecific scFv (Bis-scFv), scFv2, (Fab')$_3$, tetrameric (scFv2)$_2$, scFv2-Fc, and combinations of scFvs, $V_H$Hs, $V_{NAR}$s, and/or IgNARs with different specificities (Adams G et al., *Cancer Res* 53: 4026-34 (1993); Mallender W et al., *J Biol Chem* 269: 199-206 (1994); Todorovska A et al., *J Immunol Methods* 248: 47-66 (2001); Korn T et al., *J Gene Med* 6: 642-51 (2004); Lu D et al., *J Biol Chem* 280: 19665-72 (2005); Schneider M et al., *Eur J Immunol* 35: 987-95 (2005); Wittel U et al., *Nucl Med Biol* 32: 157-64 (2005); Semenyuk E et al., *Biochimie* 89: 31-8 (2007)).

In certain embodiments, the multivalent cell-targeting molecule of the present invention may comprise a single, continuous polypeptide component which is multimerized with itself or another protein to form a multimeric structure. For example, single-chain bivalent scFvs, sometimes referred to as tandem scFvs (taFvs), single chain diabodies (scDbs), and tandem diabodies (tanDbs or Tandabs), can be expressed as single continuous polypeptide chain (Mack M et al., *Proc Natl Acad Sci USA* 92: 7021-5 (1995); Kipriyanov S et al., *J Mol Biol* 293: 41-56 (1999); Cochlovius, B et al., *Cancer Res* 60: 4336-41 (2000); Vökel T et al., *Protein Eng* 14: 815-23 (2001); Kipriyanov S et al., *J Mol Biol* 330: 99-111 (2003); Schlereth B et al., *Cancer Res* 65: 2882-9 (2005)). These multivalent structures may be engineered to multimerize into higher-order, higher-valence structures, such as, e.g. a tetravalent F(ab')$_2$, (taFv)$_2$, and (scDb)$_2$ structures (see Todorovska A et al., *J Immunol Methods* 248: 47-66 (2001)).

Structures comprising two scFvs linked by non-covalent interactions due to the intermolecular pairing of variable regions are known to the skilled worker, such as, e.g., diabodies, mini-antibodies, and bivalent mini-antibodies, all of which may be either monospecific or bispecific (Holliger, P et al., *Proc Natl Acad Sci USA* 90: 6444-8 (1993); Pack P et al., *Biotechnology* (NY) 11: 1217-7 (1993); Tai M et al., *Cancer Res* (Suppl) 55: 5983-9 (1995); Atwell J et al., *Mol Immunol* 33: 1301-12 (1996); Rheinnecker M et al., *J Immunol* 157: 2989-97 (1996); Schier R et al., *J Mol Biol* 255: 28-43 (1996); Adams G et al., *Br J Cancer* 77: 1405-12 (1998); Todorovska A et al., *J Immunol Methods* 248: 47-66 (2001); Bühler P et al., *Cancer Immunol Immunother* 57: 43-52 (2008)). Numerous scFv monomers have been observed to naturally form multimers or oligomers (e.g. diabodies, triabodies, and tetrabodies) due to self-association, with the majority form being dimeric for scFv structures comprising linkers of 3-12 amino acid residues (Essig N et al., *J Mol Biol* 234: 897-901 (1993); Griffiths A et al., *EMBO J* 12: 725-34 (1993); Holliger P et al., *Proc Natl Acad Sci USA* 90: 6444-8 (1993); Whitlow M et al., *Protein Eng* 6: 989-95 (1993); Desplancq D et al., *Protein Eng* 7: 1027-33 (1994); Whitlow M et al., *Protein Eng* 7, 1017-26 (1994); Kortt A et al., *Protein Eng* 10: 423-33 (1997); Arndt K et al., *Biochemistry* 37: 12918-26 (1998); Atwell J et al., *Protein Eng* 12: 597-604(1999)).

In general, scFv structures with a relatively short linker of five to ten amino acid residues or less have a greater propensity for homo-dimerization (Arndt K et al., *Biochemistry* 37: 12918-26 (1988); Holliger P et al., *Proc Natl Acad Sci USA* 90: 6444-8 (1993); Perisic O et al., *Structure* 2: 1217-26 (1994); Atwell J et al., *Mol Immunol* 33: 1301-12 (1996); Iliades P et al., *FEBS Lett* 409: 437-41 (1997); Kortt A et al., *Protein Eng* 10: 423-33 (1997); Metzger D et al., *Protein Eng* 10: 423-33 (1997); Pei X et al., *Proc Natl Acad Sci USA* 94: 9637-42 (1997); Atwell J et al., *Protein Eng* 12: 597-604 (1999); Denton G et al., *Cancer Immunol Immunother* 48: 29-38 (1999); Le Gall F et al., *FES Lett* 453: 164-8 (1999); Atwell J et al., *Protein Eng* 12: 597-604 (1999); Dolezal, O et al., *Protein Eng* 13: 565-74 (2000); Nielsen U et al., *Cancer Res* 60: 6434-40 (2000); Todorovska A et al., *J Immunol Methods* 248: 47-66 (2001); Wu A et al., *Protein Eng* 14: 1025-33 (2001); Arndt M et al., *FEBS Lett* 578: 257-61 (2004); Le Gall F et al., *J Immunol Methods* 285: 111-27 (2004)). In contrast, scFvs with linkers comprising at least 12 amino acid residues predominantly form monomers with only a minority fraction undergoing spontaneous multimerization (Nielsen U et al., *Cancer Res* 60: 6434-40 (2000); Denton G et al., *Cancer Immunol Immunother* 48: 29-38 (1999); Kortt A et al., *Biomol Eng* 18: 95-108 (2001); Völkel T et al., *Protein Eng* 14: 815-23 (2001)).

The use of linkers of three amino acid residues or fewer may promote multimerization to higher order structures larger than dimeric forms. If an scFv has a linker of less than 3 residues, then trimerization may be favored (Iliades P et al., *FEBS Lett* 409: 437-41 (1997)); Kortt A et al., *Biomol Eng* 18: 95-108 (2001); Todorovska A et al., *J Immunol Methods* 248: 47-66 (2001); Arndt M et al., *FEBS Lett* 578: 257-61 (2004)). Furthermore, scFvs with very short linkers, e.g., linkers of 2 amino acid residues or less, often form trimers and/or mixtures of trimers and tetramers (Pei X et al., *Proc Natl Acad Sci USA* 94: 9637-42 (1997); Hudson P, Kortt A, *J Immunol Methods* 231: 177-89 (1999); Dolezal O et al., *Protein Eng* 13: 565-74 (2000); Power B et al., *Protein Sci* 12: 734-47 (2003); Le Gall F et al., *J Immunol Methods* 285: 111-27 (2004)). In certain arrangements with short linkers, tetramers may be favored (Dolezal O et al., *Protein Eng* 13: 565-74 (2003); Arndt M et al., *FEBS Lett* 578: 257-61 (2004)). Multimeric structures can be formed by scFvs lacking any linker, i.e. having a linker length of zero amino acid residues. For example, the direct linkage of variable domains with $V_L$ before Vii may favor the formation of tetrabodies (Iliades P et al., *FEBS Lett* 409: 437-41 (1997)) whereas $V_H$ before $V_L$ may favor trimers (Kortt A et al., *Protein Eng* 10: 423-33 (1997)).

In addition to the linker length, the orientation of the variable domains may affect multimerization characteristics (Huston J et al., *Proc Natl Acad Sci USA* 85, 5879-83 (1988); Padlan E, *Mol Immunol* 31: 169-217 (1994); Kortt A et al., *Protein Eng* 10: 423-33 (1997); Dolezal, O et al., *Protein Eng* 13: 565-74 (2000); Carmichael J et al., *J Mol Biol* 326: 341-51 (2003); Arndt M et al., *FEBS Lett* 578: 257-61 (2004)). It has been suggested that the $V_L$-$V_H$ orientation exhibits a greater tendency to form higher molecular weight oligomers than does the reverse orientation because the $V_L$-$V_H$ orientation is more constrained (Kortt A et al.,

*Protein Eng* 10: 423-33 (1997); Dolezal, O et al., *Protein Eng* 13: 565-74 (2000); Plückthun A, Pack P, *Immunotechnology* 3: 83-105 (1997)).

The same linker has shown variability in its effect on scFv multimerization depending on the $V_H$ and $V_L$ orientation, such as, e.g., affecting the relative proportions of dimeric to trimeric forms (Le Gall F et al., *FEBS Lett* 453: 164-8 (1999); Arndt M et al., *FEBS Lett* 578: 257-61 (2004); Le Gall F et al., *J Immunol Methods* 285: 111-27 (2004)).

Camelid $V_H$H immunoglobulin domains have been multimerized using particular hinges and covalently linked multi $V_H$-H chains (tandem) (Fraile S et al., *Mol Microbiol* 53: 1109-21 (2004); Zhang J et al., *J Mol Biol* 335: 49-56 (2004)). Immunoglobulin domains from Chondrichthyes, such as IgNARs, have been multimerized using certain hinges or cysteine-mediated disulfide bond stabilization (see e.g. Simmons et al., *J Immunol Methods* 315: 171-84 (2006)).

Thus, the generation of multivalent cell-targeting molecules comprising various immunoglobulin domains may be controlled by molecular engineering strategies which are either covalent or non-covalent, such as, e.g., covalent strategies involving single-chain tandem arrangements, covalent strategies involving cysteine-mediated, disulfide bond stabilized multimers, and/or non-covalent strategies involving dimerization domains, linker choice, and/or variable domain order. Multiple strategies (e.g., linker-related non-covalent multimerization and covalent disulfide bond stabilization) may be combined when creating structures that are multivalent cell-targeting molecules of the present invention (see e.g. Lu D et al., *J Immunol Methods* 279: 219-32 (2003)).

For certain applications, the stability of the relative proportion of multivalent cell-targeting molecule(s) to total cell-targeting molecules in a composition of the present invention may be important to the composition's effectiveness. For example in certain medical applications, the stability of the relative proportions of multivalent cell-targeting molecule(s) of the present invention to monovalent cell-targeting molecule(s) may be important. In certain applications, the stability of the relative proportions of bivalent cell-targeting molecules to higher-valence cell-targeting molecules may be important. In certain applications the stability of the relative proportion of bivalent cell-targeting molecules to non-bivalent cell-targeting molecules may be important.

For certain embodiments, a one or more steps of controlled multimerization of some or all of the components of a multivalent cell-targeting molecule of the present invention may be used to produce a composition of the present invention.

For certain applications, the minimization or otherwise controlling of unwanted aggregation and/or multimerization of cell-targeting molecules may be important for certain compositions of the present invention. For example with certain proteinaceous therapeutics, the aggregation and/or multimerization of the therapeutic molecule can in certain situations increase the risk for unwanted immune responses in recipients of the proteinaceous therapeutic. In particular, cell-targeting molecule aggregation and/or multimerization to higher molecular weight complexes may increase the risk of unwanted immune responses after administration of certain cell-targeting molecule compositions to certain recipients. In addition, misfolded proteins and degraded protein products can exhibit increased immunogenicity as compared to their properly folded counterparts.

For all of these reasons and depending on the specific application, the skilled worker will appreciate whether there is a need to consider 1) the stability of multivalent cell-targeting molecules of the compositions of the present invention and 2) the stability of the ratios of different cell-targeting molecules present in compositions of the present invention. For example, in certain embodiments, the multivalent cell-targeting molecule of the present invention and compositions thereof are the result of controlled multimerization and/or certain purification steps. Similarly, in certain embodiments, the multivalent cell-targeting molecule of the present invention will be engineered to eliminate or reduce certain multimerization possibilities. In certain embodiments, the multivalent cell-targeting molecule of the present invention will be designed to avoid the formation of unwanted aggregates, such as, e.g., under certain storage conditions like in an aqueous solution at 8, 4, 2, −4, −10, −20, or −25° C.

For certain applications of the compositions of the present invention, it may be desirable to minimize in the composition of the present invention the amount of: 1) high molecular weight, multivalent cell-targeting molecules (e.g. molecules greater than 175, 180, 190, 200, or 250 kDa or larger); 2) greatly multivalent cell-targeting molecules (i.e. molecules comprising five or more cell-targeting binding regions); 3) multimers of cell-targeting molecules which are high molecular weight, multivalent cell-targeting molecules representing #1 and/or greatly multivalent cell-targeting molecules representing #2 (e.g. certain, large, noncovalent multimers of cell-targeting molecules); 3) misfolded proteins (e.g., misfolded cell-targeting proteins or protein components thereof); and/or 4) degradation products (e.g. unwanted protein fragments of a proteinaceous component of a multivalent cell-targeting molecule, such as, e.g., a polypeptide fragment of a Shiga toxin effector region or cell-targeting binding region). For example, a rationale to minimize the amount of any of the types of molecules listed as #1-#4 above might be for medical applications where the presence of a certain amounts of these molecules might increase the potential for unwanted antigenic and/or immunogenic reactions in a recipient of a compositions of the present invention, such as, e.g., by the presence of these molecules revealing new epitopes or by forming repetitive motifs more readily identified by a recipient's immune system as foreign.

The skilled worker may use routine methods to assess multimerization states of the multivalent cell-targeting molecules of the present invention and/or molecules present in the compositions of the present invention. The skilled worker may use routine methods to minimize the presence or relative proportion of cell-targeting molecule aggregates, high molecular weight cell-targeting protein multimers, misfolded cell-targeting proteins, and degradation products of cell-targeting protein in the compositions of the present invention.

In certain embodiments of the compositions of the present invention, the relative proportion of bivalent, trivalent, and/or tetravalent forms of multivalent cell-targeting molecule(s) is maximized, such as by further purifying away from monovalent cell-targeting protein(s), higher molecular weight cell-targeting molecule(s), misfolded cell-targeting protein(s), and/or protein degradation product(s).

The skilled worker may use routine methods to create a multivalent cell-targeting molecule of the present invention, and compositions thereof. The skilled worker may use routine methods to stabilize the relative proportions of certain multivalent cell-targeting molecules to other molecules in a composition of the present invention, including the proportions of different multimeric forms of cell-targeting molecules, such as, e.g., the proportions of covalently linked, multimeric, multivalent cell-targeting molecules to non-covalently linked, multimeric, multivalent cell-targeting molecules (see e.g. Gil D, Schrum A, *Adv Biosci Biotechnol* 4: 73-84 (2013); WO2005000898). For example, the multimerization of cell-targeting molecule(s) in compositions of the present invention may be controlled and/or minimized, such as, e.g., by choosing certain linkers to link and/or associate different components and/or subunits of the cell-targeting molecule(s) present in the compositions of the present invention. For example, in certain embodiments, the cell-targeting binding region of the multivalent cell-targeting molecule of the present invention is engineered to minimize the formation of unwanted, intermolecular associations, multimers, and/or aggregates, such as, e.g., by using disulfide-stabilized scFvs, Fv fragments, or Fabs (see e.g. Reiter Y et al., *J Biol Chem* 269: 18327-31 (1994); Kuan C, Pastan I, *Biochemistry* 35: 2872-7 (1996); Almog O et al., *Proteins* 31: 128-38 (1998); Schoonjans R et al., *J Immunol* 165: 7050-7 (2000); Olafsen T et al., *Protein Eng Des Sel* 17: 21-7 (2004); Gil D, Schrum A, *Adv Biosci Biotechnol* 4: 73-84 (2013); U.S. 20120283418); base loop connections (see e.g. Brinkmann U et al., *J Mol Biol* 268: 107-17 (1997)); and/or other modifications, such as the addition of charged resides, glycans, and/or immunoglobulin-domain truncations (see e.g. Gong R et al., *Mol Pharm* 10: 2642-52 (2013); Lee C et al., *Trends Biotechnol* 31: 612-20 (2013)).

In certain embodiments of the present invention, the multivalent cell-targeting molecule of the present invention comprises a cell-targeting binding region which is an scFv engineered not to aggregate, such as, e.g., by using a shorter linker (typically less than twelve amino acid residues) and/or disulfide-stabilized linker that links the heavy and light chain regions of the scFv (see e.g., Brinkmann U et al., *Proc Natl Acad Sci USA* 90: 7538-42 (1993); Whitlow M et al., *Protein Engineering* 6: 989-95 (1993); Reiter Y et al., *Biochemistry* 33: 5451-9 (1994); Gong R et al., *Molecular Pharmaceutics* 10: 2642-52 (2013)).

In certain embodiments, the multivalent cell-targeting molecule composition of the present invention minimizes the proportion relative to other cell-targeting molecules of certain, multivalent cell-targeting molecule(s) with a valence greater than two. In certain embodiments, the multivalent cell-targeting molecule composition of the present invention comprises a relative percentage of multivalent cell-targeting molecules with a valence of greater than four which is 15%, 10%, 7.5%, 5%, 2%, 1%, or less of the total cell-targeting molecules in the composition. In certain embodiments, a multivalent cell-targeting molecule composition of the present invention comprises a relative percentage of cell-targeting molecules with a valence of greater than three to other cell-targeting molecules which is 15%, 10%, 7.5%, 5%, 2%, 1%, or less of the total cell-targeting molecules in the composition. In certain embodiments, a multivalent cell-targeting molecule composition of the present invention comprises a percentage of cell-targeting molecules with a valence greater than two which is 15%, 10%, 7.5%, 5%, 2%, 1%, or less of the total cell-targeting molecules in the composition.

In certain embodiments, the composition of the present invention maximizes the relative proportion of multivalent cell-targeting molecule(s) with exactly two cell-targeting binding regions to total cell-targeting molecules. Thus, in certain embodiments, a composition of the present invention comprises a proportion of cell-targeting molecule with only two cell-targeting binding regions which is 80%, 85%, 88%, 90%, 92%, 93%, or more of the total cell-targeting molecules in the composition.

For certain applications, it may be desirable to maintain stability (e.g., the stability of associations and/or linkages between components and/or subunits of the multivalent cell-targeting molecules) of multivalent cell-targeting molecule(s) in a multivalent composition of the present invention, such as, e.g., to minimize degradation during formulation, storage (such as, e.g., storage in an aqueous solution at 8, 4, 2, −4, −10, −20, or −25° C.), and/or after administration to a recipient. The skilled worker may use well known methods to minimize component or subunit separation for a multivalent cell-targeting molecule of the present invention, such as, e.g., by using high-stability linkages between the Shiga toxin effector polypeptide(s) and binding region(s) and/or by engineering disulfide linkages between components, regions, or sub-regions of a multivalent cell-targeting molecule or between monovalent cell-targeting proteins to generate multivalent cell-targeting protein(s) of the present invention (see e.g. Gil D, Schrum A, *Adv Biosci Biotechnol* 4: 73-84 (2013)). The skilled worker may use the addition or maintenance of intermolecular disulfide bonds to stabilize certain cell-targeting binding regions of the multivalent cell-targeting molecules of the present invention (see e.g. Glockshuber R et al., *Biochemistry* 29: 1362-7 (1990); Stanfield R et al., *Science* 305: 1770-3 (2004); Hagihara Y et al., *J Biol Chem* 282: 36489-95 (2007); Chan P et al., *Biochemistry* 47: 11041-54 (2008); Saerens D et al., *J Mol Biol* 478-88 (2008); Hussack G et al., *PLoS One* 6: e28218 (2011); Govaert J et al., *J Biol Chem* 287: 1970-9 (2012); Kim D et al., *Protein Eng Des Sel* 25: 581-9 (2012); Gil D, Schrum A, *Adv Biosci Biotechnol* 4: 73-84 (2013); McConnell A et al., *Protein Eng Des Sel* 25: 581-9 (2013); Feige M et al., *Proc Natl Acad Sci USA* 111: 8155-60 (2014); Hagihara Y, Saerens D, *Biochim Biophys Acta* 1844: 2016-2023 (2014); Kim D et al., *Mabs* 6: 219-35 (2014)).

In certain embodiments, the multivalent cell-targeting molecule of the present invention comprises a cell-targeting binding region(s) which comprises an immunoglobulin domain and/or Ig-fold structure having an intra-domain disulfide bond, such as, e.g., the disulfide bond found natively between the B and F β strands of certain immunoglobulins and/or a disulfide bond between their heavy and light chains of or derived from an immunoglobulin. However, in certain embodiments of the multivalent cell-targeting molecules of the present invention, the molecules are very stable even though they do not comprise an intra-domain disulfide bond or any intra-domain disulfide bond within one or more cell-targeting binding regions (see e.g. Proba K et al., *Biochemistry* 37: 13120-7 (1998); Wörn A, Plückthun A, *Biochemistry* 37: 13120-7 (1998); Wörn A, Plückthun A, *FEBS Lett* 427: 357-61 (1998); Ramm K et al., *J Mol Biol* 290: 535-46 (1999); Tanaka T, Rabbitts T, *J Mol Biol* 376: 749-57 (2008)).

In certain embodiments, the composition of the present invention comprises a multivalent cell-targeting molecule with one or more disulfide bonds between two or more cysteine residues contained within Shiga toxin effector polypeptide regions of different polypeptide chains. In certain embodiments, the composition of the present invention comprises a proteinaceous, dimeric, multivalent cell-targeting molecule with five disulfide bonds, such as, e.g., the dimeric, multivalent cell-targeting molecule comprising: 1) four, intramolecular, disulfide bonds representing two disulfide bonds per immunoglobulin-derived cell-targeting binding region and where each disulfide bond involves a pair of cysteine residues and wherein one cysteine residue of each pair is within an immunoglobulin heavy chain derived domain and the other cysteine residue of the pair is within an immunoglobulin light chain derived domain; and 2) one, intermolecular, disulfide bond bridging two, Shiga toxin effector regions wherein the disulfide bond occurs between a pair of cysteine residues where each cysteine residue of the pair is within a Shiga toxin effector region but the Shiga toxin effector regions are within different polypeptide chains representing different subunits of a multivalent cell-targeting protein of the present invention.

Certain embodiments of the multivalent cell-targeting molecules of the present invention are cytotoxic, cell-targeting, fusion proteins. Certain further embodiments are the cell-targeting molecules which comprise or consist essentially of two or more of the polypeptides shown in SEQ ID NOs: 252-255, 259-278, and 288-748.

For the purposes of the present invention, the specific order or orientation is not fixed for the Shiga toxin effector polypeptide(s) and the two or more binding regions in relation to each other or the entire multivalent cell-targeting molecule of the present invention. The components of the multivalent cell-targeting molecules of the present invention may be arranged in any order provided that the desired activities of the binding regions and the Shiga toxin effector polypeptide(s) are not eliminated, notably the ability of the cell-targeting molecule to bind target-expressing cells, the ability of the cell-targeting molecule to internalize into a target cell, and the ability of the Shiga toxin effector polypeptide component to deliver a CD8+ T-cell epitope-peptide cargo to the MHC class I pathway of a cell in which it is present. Other desired activities include providing the multivalent cell-targeting molecule with the ability to, e.g., rapidly induce cellular internalization; cause efficient internalization; intracellularly route to a desired subcellular compartment(s); cause cytostasis; cause cytotoxicity; selectively kill target-expressing cells; deliver exogenous materials into the interior of a cell; diagnosis a disease, disorder, or condition; and/or treat a disease, disorder, or condition in a patient in need thereof.

Cell-targeting molecules of the present invention each comprise a cell-targeting binding region which can bind specifically to at least one extracellular target biomolecule in physical association with a cell, such as a target biomolecule expressed on the surface of a cell. This general structure is modular in that any number of diverse cell-targeting moieties may be used as a binding region of a cell-targeting molecule of the present invention. It is within the scope of the present invention to use fragments, variants, and/or derivatives of the cell-targeting molecules of the present invention which contain a functional binding site to any extracellular part of a target biomolecule, and even more preferably capable of binding a target biomolecule with high affinity (e.g. as shown by a $K_D$ less than $10^{-9}$ moles/liter). For example, while the invention provides polypeptide sequences that can bind to human proteins, any binding region that binds an extracellular part of a target biomolecule with a dissociation constant ($K_D$) of $10^{-5}$ to $10^{-12}$ moles/liter, preferably less than 200 nM, may be substituted for use in making cell-targeting molecules of the invention and methods of the invention.

III. General Functions of the Cell-Targeting Molecules of the Present Invention

The cell-targeting molecules of the present invention may be used as cell-targeted cytotoxic molecules, therapeutic molecules, cell-labeling molecules, and diagnostic molecules, e.g., via their abilities to target specific cell-types based on cell-surface marker expression, entering target cells, delivering intracellularly its heterologous CD8+ T-cell epitope-peptide cargo to the MHC class I pathway resulting in cell-surface presentation of the CD8+ T-cell epitope-peptide by the target cell(s).

For certain embodiments, the cell-targeting molecule of the present invention provides, after administration to a chordate, one or more of the following: 1) potent and selective killing of targeted cells, e.g., infected and/or neoplastic cells, 2) linkage stability between the cell-targeting binding region and the Shiga toxin effector polypeptide component while the cell-targeting molecule is present in extracellular spaces, e.g., in the circulatory system of a chordate (see e.g WO 2015/191764), 3) low levels of off-target cell deaths and/or unwanted tissue damage (see e.g. WO 2015/191764), and 4) cell-targeted delivery of a heterologous, CD8+ T-cell epitope cargo for cell-surface presentation by MHC class I molecules of target cells in order to stimulate desirable immune responses, such as, e.g., the recruitment of CD8+ CTLs and the localized release of immuno-stimulatory cytokines at a tissue locus, e.g. a tumor mass. Furthermore, the presentation of delivered, heterologous, CD8+ T-cell epitope-peptides by target cells marks those presenting cells with pMHC Is that can be detected for the purposes of gathering information, such as, e.g., for diagnostic information.

The cell-targeting molecules of the present invention are useful in diverse applications involving, e.g., targeted delivery of a CD8+ T-cell epitope-cargo, immune response stimulation, targeted cell-killing, targeted cell growth inhibition, biological information gathering, and/or remediation of a health condition. The cell-targeting molecules of the present invention are useful as therapeutic and/or diagnostic molecules, such as, e.g., as cell-targeting, nontoxic, delivery vehicles; cell-targeting, cytotoxic, therapeutic molecules; and/or cell-targeting, diagnostic molecules; for examples in applications involving the in vivo targeting of specific cell-types for the diagnosis or treatment of a variety of diseases, including cancers, immune disorders, and microbial infections. Certain cell-targeting molecules of the present invention may be used to treat a chordate afflicted with a tumor or cancer by enhancing the effectiveness of that chordate's anti-tumor immunity, particularly involving CD8+ T-cell mediated mechanisms (see e.g. Ostrand-Rosenberg S, *Curr Opin Immunol* 6: 722-7 (1994); Pietersz G et al., *Cell Mol Life Sci* 57: 290-310 (2000); Lazoura E et al., *Immunology* 119: 306-16 (2006)).

Depending on the embodiment, a cell-targeting molecule of the present invention may have or provide one or more of the following characteristics or functionalities: (1) in vivo stimulation of CD8+ T-cell immune response(s), (2) de-immunization (see e.g. WO 2015/113005, WO 2015/113007, and WO 2015/191764), (3) protease-cleavage resistance (see e.g. WO 2015/191764 and WO 2015/191764), (4) potent cytotoxicity at certain concentrations, (5) selective cytotoxicity, (6) low off-target toxicity in multicellular organisms at certain doses or dosages (see e.g. WO 2015/191764 and WO 2015/191764), and/or (7) intracellular delivery of a cargo consisting of an additional material (e.g. a nucleic acid or detection promoting agent). Certain embodiments of the cell-targeting molecules of the present invention are multi-functional because the molecules have two or more of the characteristics or functionalities described herein. Certain further embodiments of the cell-targeting molecules of the present invention provide all of the aforementioned characteristics and functionalities in a single molecule.

The mechanisms of action of the therapeutic, cell-targeting molecules of the present invention include direct target cell-killing via Shiga toxin effector functions, indirect cell-killing via intercellular immune-cell-mediated processes, and/or educating a recipient's immune system to reject certain cells and tissue loci, e.g. a tumor mass, as a result of "CD8+ T-cell epitope seeding."

A. Delivery of the Heterologous. CD8+ T-Cell Epitope Cargo to the MHC Class I Presentation Pathway of a Target Cell One of the primary functions of the cell-targeting molecules of the present invention is cell-targeted delivery of one or more heterologous, CD8+ T-cell epitope-peptides for MHC class I presentation by a chordate cell. The cell-targeting molecules of the present invention are modular scaffolds for use as general delivery vehicles of virtually any CD8+ T-cell epitope cargo to virtually any chordate target cell. Targeted delivery requires the cell-targeting molecule to specifically bind to a certain target cell, enter the target cell, and deliver an intact heterologous, CD8+ T-cell epitope-peptide cargo to a subcellular compartment competent for entry into the MHC class I presentation pathway. Delivery of a CD8+ T-cell epitope-peptide cargo to the MHC class I presentation pathway of a target cell using a cell-targeting molecule of the invention can be used to induce the target cell to present the epitope-peptide in association with MHC class I molecules on a cell surface.

By using immunogenic MHC class I epitopes, such as, e.g., from a known viral antigen, as heterologous, CD8+ T-cell epitope-peptide cargos of the cell-targeting molecules of the present invention, the targeted delivery and presentation of immuno-stimulatory antigens may be accomplished in order to stimulate a beneficial function(s) of a chordate immune cell, e.g. in vitro, and/or a chordate immune system in vivo.

In a chordate, the presentation of an immunogenic, CD8+ T-cell epitope by the MHC class I complex can target the presenting cell for killing by CTL-mediated cytolysis, promote immune cells into altering the microenvironment, and signal for the recruitment of more immune cells to the target cell site within the chordate. Certain cell-targeting molecules of the present invention are capable of delivering under physiological conditions its heterologous, CD8+ T-cell epitope-peptide cargo to the MHC class I pathway of a target chordate cell for presentation of the delivered T-cell epitope complexed with a MHC class I molecule. This may be accomplished by exogenous administration of the cell-targeting molecule into an extracellular space, such as, e.g., the lumen of a blood vessel, and then allowing for the cell-targeting molecule to find a target cell, enter the cell, and intracellularly deliver its CD8+ T-cell epitope cargo. The presentation of a CD8+ T-cell epitope by a target cell within a chordate can lead to an immune response(s), including responses directly to the target cell and/or general responses in the tissue locale of the target cell within the chordate.

The applications of these CD8+ T-cell epitope cargo delivery and MHC class I presenting functions of the cell-targeting molecules of the present invention are vast. For example, the delivery of a CD8+ epitope to a cell and the MHC class I presentation of the delivered epitope by the cell in a chordate can cause the intercellular engagement of a CD8+ effector T-cell and may lead to a CTL(s) killing the target cell and/or secreting immuno-stimulatory cytokines.

The cell-targeting molecules of the present invention are capable, upon exogenous administration, of delivering one or more CD8+ T-cell epitope cargos for MHC class I presentation by a nucleated, chordate cell. For certain embodiments, the cell-targeting molecules of the present invention are capable of binding extracellular target biomolecules associated with the cell surface of particular cell-types and entering those cells. Once internalized within a targeted cell-type, the cell-targeting molecules of the invention are capable of delivering a CD8+ T-cell epitope cargo to the MHC class I presentation pathway and certain further embodiments of the cell-targeting molecules of the invention are capable of routing a Shiga toxin effector polypeptide component (whether catalytically active, reduced-cytotoxicity, or non-toxic) to the cytosol of the cell.

For certain embodiments, the cell-targeting molecule of the present invention is capable, from an extracellular space, of delivering one or more heterologous, CD8+ T-cell epitope-peptide cargos to the proteasome of a target cell. The delivered CD8+ T-cell epitope-peptide cargo can then be proteolytic processed and presented by the MHC class T pathway on the surface of the target cell. For certain embodiments, the cell-targeting molecule of the present invention is capable of delivering the heterologous, CD8+ T-cell epitope-peptide cargo, which is associated with the cell-targeting molecule, to a MHC class I molecule of a cell for presentation of the epitope-peptide by the MHC class I molecule on a surface of the cell. For certain embodiments, upon contacting a cell with the cell-targeting molecule of the present invention, the cell-targeting molecule is capable of delivering the heterologous, CD8+ T-cell epitope-peptide cargo, which is associated with the cell-targeting molecule, to a MHC class I molecule of the cell for presentation of the epitope-peptide by the MHC class I molecule on a surface of the cell.

For certain embodiments, the cell-targeting molecule of the present invention is capable, upon administration to a chordate subject, of targeting delivery of one or more heterologous, CD8+ T-cell epitope cargos for MHC class I presentation by specific target cells within the subject.

In principle, any CD8+ T-cell epitope-peptide may be chosen for use in a cell-targeting molecule of the present invention. Thus, cell-targeting molecules of the invention are useful for labeling the surfaces of target cells with MIC class I molecules complexed with the epitope-peptide of your choice.

Every nucleated cell in a mammalian organism may be capable of MHC class I pathway presentation of immunogenic, CD8+ T-cell epitope peptides on their cell outer surfaces complexed to MHC class I molecules. In addition, the sensitivity of T-cell epitope recognition is so exquisite that only a few MHC-I peptide complexes are required to be presented to result in an immune response, e.g., even presentation of a single complex can be sufficient for the intercellular engagement of a CD8+ effector T-cell (Sykulev Y et al., *Immunity* 4: 565-71 (1996)). Target cells of a cell-targeting molecule of the present invention can be virtually any nucleated chordate cell-type and need not be immune cells and/or professional antigen presenting cells. Examples of professional antigen presenting cells include dendritic cells, macrophages, and specialized epithelial cells with functional MHC class II systems. In fact, preferred embodiments of the cell-targeting molecules of the present invention do not target professional antigen presenting cells. One reason is that an undesirable immune response as a result of the administration of the cell-targeting molecule of the present invention would be a humoral response directed to the cell-targeting molecule itself, such as, e.g., an anti-cell-targeting molecule antibody recognizing an epitope in the cell-targeting molecule. Thus, professional antigen presenting cells and certain immune cell-types are not to be targeted by certain embodiments of the cell-targeting molecules of the present invention because the uptake of the cell-targeting molecule of the present invention by these cells may lead to the recognition of CD4+ T-cell and B-cell epitopes present in the cell-targeting molecule, particularly in the Shiga toxin effector polypeptide component(s) and/or an antigenic cargo, but also including in the binding region.

The ability to deliver a CD8+ T-cell epitope by certain embodiments of the cell-targeting molecules of the present invention may be accomplished under varied conditions and in the presence of non-targeted bystander cells, such as, e.g., an ex vivo manipulated target cell, a target cell cultured in vitro, a target cell within a tissue sample cultured in vitro, or a target cell in an in vivo setting like within a multicellular organism.

In order for a cell-targeting molecule of the present invention to function as designed, the cell-targeting molecule must 1) enter a target cell and 2) localize its CD8+ T-cell epitope-peptide cargo to a subcellular location competent for entry into the MIC class I pathway. Commonly, cell-targeting molecules of the invention accomplish target cell internalization via endocytosis, such as, e.g., due to a natural process involving the extracellular target biomolecule bound by the cell-targeting molecule. Once the cell-targeting molecule of the invention is internalized, it will typical reside in an early endosomal compartment, such as, e.g., endocytotic vesicle and be destined for destruction in a lysosome or late endosome. A cell-targeting molecule must avoid complete sequestration and degradation such that at least a portion of the cell-target molecule comprising the T-cell epitope-peptide cargo escapes to another subcellular compartment. Furthermore, the target cell should either express a MHC class I molecule or be capable of being induced to express a MHC class I molecule.

The expression of the MHC class I molecule need not be native in order for cell-surface presentation of a heterologous, CD8+ T-cell epitope-peptide (delivered as a cargo by a cell-targeting molecule of the present invention) complexed with a MHC class I molecule. For certain embodiments of the present invention, the target cell may be induced to express MHC class I molecule(s) using a method known to the skilled worker, such as, e.g., by treatment with IFN-γ.

Commonly, cell-targeting molecules of the invention accomplish MHC class I pathway delivery by localizing their CD8+ T-cell epitope-peptide cargos to proteasomes in cytosolic compartments of target cells. However, for certain embodiments, the cell-targeting molecule of the present invention may deliver a heterologous, CD8+ epitope-peptide to the MHC class I presentation pathway without the epitope-peptide ever entering a cytosolic compartment and/or without the epitope-peptide ever being proteolytically processed by the proteasome.

For certain embodiments of the present invention, the target cell may be induced to express different proteasome subunits and/or proteasome subtypes using a method known to the skilled worker, such as, e.g., by treatment with IFN-γ and/or TNF-α. This can alter the positioning and/or relative efficiency of proteolytic processing of CD8+ epitope peptides delivered into the cell, such as, e.g., by altering the relative levels of peptidase activities of proteasomes and proteasome subtypes.

The CD8+ T-cell epitope delivering functions of the cell-targeting molecules of the present invention can be detected and monitored by a variety of standard methods known in the art to the skilled worker and/or described herein. For example, the ability of cell-targeting molecules of the present invention to deliver a CD8+ T-cell epitope-peptide cargo and drive presentation of this peptide by the MHC class I system of target cells may be investigated using various in vitro and in vivo assays, including, e.g., the direct detection/visualization of MHC class T/peptide complexes (pMHC Is), measurement of binding affinities for the T-cell peptide to MHC class I molecules, and/or measurement of functional consequences of pMHC I presentation on target cells, e.g., by monitoring cytotoxic T-lymphocyte (CTL) responses (see e.g. Examples, infra).

Certain assays to monitor and quantitate the CD8+ T-cell epitope cargo delivering function of the cell-targeting molecules of the present invention involve the direct detection of a specific pMHC Is in vitro or ex vivo. Common methods for direct visualization and quantitation of pMHC Is involve various immuno-detection reagents known to the skilled worker. For example, specific monoclonal antibodies can be developed to recognize a particular pMHC I. Similarly, soluble, multimeric T cell receptors, such as the TCR-STAR reagents (Altor Bioscience Corp., Miramar, Fla., U.S.) can be used to directly visualize or quantitate specific pMHC Is (Zhu X et al., *J Immunol* 176: 3223-32 (2006); see e.g., Examples, infra). These specific mAbs or soluble, multimeric T-cell receptors may be used with various detection methods, including, e.g. immunohistochemistry, flow cytometry, and enzyme-linked immunosorbent assay (ELISA).

An alternative method for direct identification and quantification of pMHCs involves mass spectrometry analyses, such as, e.g., the ProPresent Antigen Presentation Assay (ProImmune, Inc., Sarasota, Fla., U.S.) in which peptide-MHC class I complexes are extracted from the surfaces of cells, then the peptides are purified and identified by sequencing mass spectrometry (Falk K et al., *Nature* 351: 290-6 (1991)).

In certain assays to monitor the CD8+ T-cell epitope delivery and MHC class I presentation function of the cell-targeting molecules of the present invention involve computational and/or experimental methods to monitor MHC class I and peptide binding and stability. Several software programs are available for use by the skilled worker for predicting the binding responses of peptides to MHC class I alleles, such as, e.g., The Immune Epitope Database and Analysis Resource (IEDB) Analysis Resource MHC-1 binding prediction Consensus tool (Kim Y et al., *Nucleic Acid Res* 40: W525-30 (2012)). Several experimental assays have been routinely applied, such as, e.g., cell surface binding assays and/or surface plasmon resonance assays to quantify and/or compare binding kinetics (Miles K et al., *Mol Immunol* 48: 728-32 (2011)).

Alternatively, measurements of the consequence of pMHC I presentation on the cell surface can be performed by monitoring the cytotoxic T lymphocyte (CTL) response to the specific complex. These measurements by include direct labeling of the CTLs with MHC class I tetramer or pentamer reagents. Tetramers or pentamers bind directly to T cell receptors of a particular specificity, determined by the Major Histocompatibility Complex (MHC) allele and peptide complex. Additionally, the quantification of released cytokines, such as interferon gamma or interleukins by ELISA or enzyme-linked immunospot (ELIspot) is commonly assayed to identify specific CTL responses. The cytotoxic capacity of CTL can be measured using a number of assays, including the classical 51 Chromium (Cr) release assay or alternative non-radioactive cytotoxicity assays (e.g., CytoTox96@ non-radioactive kits and CellTox™ Cell- Titer-GLO® kits available from Promega Corp., Madison, Wis., U.S.), Granzyme B ELISpot, Caspase Activity Assays or LAMP-1 translocation flow cytometric assays. To specifically monitor the killing of target cells, carboxyfluorescein diacetate succinimidyl ester (CFSE) can be used to easily and quickly label a cell population of interest for in vitro or in vivo investigation to monitor killing of epitope specific CSFE labeled target cells (Durward M et al., *J Vis Exp* 45 pii 2250 (2010)).

In vivo responses to MHC class I presentation can be followed by administering a MHC class I/antigen promoting agent (e.g., a peptide, protein or inactivated/attenuated virus vaccine) followed by challenge with an active agent (e.g. a virus) and monitoring responses to that agent, typically in comparison with unvaccinated controls. Ex vivo samples can be monitored for CTL activity with methods similar to those described previously (e.g. CTL cytotoxicity assays and quantification of cytokine release).

MHC class I presentation in an organism can be followed by reverse immunology. For example, HLA-A, HLA-B, and/or HLA-C molecule complexes are isolated from cells intoxicated with a cell-targeting molecule of the present invention comprising antigen X after lysis using immune affinity (e.g., an anti-MHC I antibody "pulldown" purification) and associated peptides (i.e., the peptides that were bound by the isolated pMHC Is) are recovered from the purified complexes. The recovered peptides are analyzed by sequencing mass spectrometry. The mass spectrometry data is compared against a protein database library consisting of the sequence of the exogenous (non-self) peptide (antigen X) and the international protein index for humans (representing "self" or non-immunogenic peptides). The peptides are ranked by significance according to a probability database. The detected antigenic (non-self) peptide sequences are listed. The data is verified by searching against a scrambled decoy database to reduce false hits (see e.g. Ma B, Johnson R, *Mol Cell Proteomics* 11: 0111.014902 (2012)). The results can demonstrate which peptides from the CD8+ T-cell antigen X are presented in MHC I complexes on the surface of cell-targeting molecule intoxicated target cells.

B. Cell Kill: Directly Targeted Shiga Toxin Cytotoxicity and/or Indirectly Targeted Cell-Mediated Cytotoxicity Via the Recruitment of CTLs Cell-targeting molecules of the present invention can provide cell-type specific delivery of: 1) CD8+ T-cell epitope cargos to the MHC class I presentation pathway for presentation and intercellular engagement of CTL(s) as well as 2) potent Shiga toxin cytotoxicity to the cytosol. These multiple cytotoxic mechanisms may complement each other, such as by providing both direct (e.g. Shiga toxin catalysis mediated) target-cell-killing and indirect (e.g. CTL-mediated) target-cell-killing.

For certain embodiments, the cell-targeting molecule of the present invention is cytotoxic at certain concentrations. The cell-targeting molecules of the present invention may be used in application involving indirect (e.g. via intercellular CD8+ immune cell engagement) and/or direct cell killing mechanisms (e.g. via intracellular toxin effector activity). Because Shiga toxins are adapted to killing eukaryotic cells, cytotoxic cell-targeting molecules designed using Shiga toxin A Subunit derived polypeptides can show potent cell-kill activity. Shiga toxin A Subunits and derivatives thereof which comprise active enzymatic domains can kill a eukaryotic cell once in the cell's cytosol. The fusion of a cell-targeting binding region and a heterologous, CD8+ T-cell epitope-peptide to a de-immunized and protease-cleavage resistant, Shiga toxin A Subunit effector polypeptide can be accomplished without significantly reducing the Shiga toxin effector polypeptide's catalytic and cytotoxic activities (see Examples, infra). Thus, certain cell-targeting molecules of the present invention can provide at least two redundant, mechanisms of target cell killing—(1) indirect, immune cell-mediated killing as a result of heterologous, CD8+ epitope cargo delivery by the cell-targeting molecule of the present invention and (2) direct killing via the functional activity(ies) of a Shiga toxin effector polypeptide component of the cell-targeting molecule of the invention.

For certain embodiments of the cell-targeting molecules of the present invention, upon contacting a target cell physically coupled with an extracellular target biomolecule of the binding region of the molecule, the cell-targeting molecule is capable of causing death of the target cell. The mechanism of cell-kill may be direct, e.g. via the enzymatic activity of the Shiga toxin effector polypeptide, or indirect via immune cell-mediated mechanisms, e.g. CTL-mediated target cell cytolysis, and may be under varied conditions of target cells, such as an ex vivo manipulated target cell, a target cell cultured in vitro, a target cell within a tissue sample cultured in vitro, or a target cell in vivo.

The expression of the target biomolecule need not be native in order for targeted cell killing by a cell-targeting molecule of the invention. Cell-surface expression of the target biomolecule could be the result of an infection, the presence of a pathogen, and/or the presence of an intracellular microbial pathogen.

Expression of a target biomolecule could be artificial such as, for example, by forced or induced expression after infection with a viral expression vector, see e.g. adenoviral, adeno-associated viral, and retroviral systems. An example of inducing expression of a target biomolecule is the upregulation of CD38 expression of cells exposed to retinoids, like all-trans retinoic acid and various synthetic retinoids, or any retinoic acid receptor (RAR) agonist (Drach J et al., *Cancer Res* 54: 1746-52 (1994); Uruno A et al., *J Leukoc Biol* 90: 235-47 (2011)). In another example, CD20, HER2, and EGFR expression may be induced by exposing a cell to ionizing radiation (Wattenberg M et al., *Br J Cancer* 110: 1472-80 (2014)). Further, PSMA expression is upregulated in response to androgen deprivation (see e.g. Chang S et al., *Cancer* 88: 407-15 (2000); Meller B et al., *EJNMMI Res* 5: 66 (2015)).

For certain embodiments of the cell-targeting molecules of the present invention, the cell targeting molecules are cytotoxic because delivery of the molecule's heterologous, CD8+ T-cell epitope(s) cargo results in MHC class I presentation of the delivered epitope-peptide(s) by the target cell and immune cell mediated killing of the target cell.

Certain cell-targeting molecules of the present invention may be used in applications involving indirect cell-kill mechanisms, such as, e.g., stimulating CD8+ immune cell mediated, target cell killing. The presentation by targeted cells of immuno-stimulatory non-self antigens, such as, e.g., known viral epitope-peptides with high immunogenicity, can signal to other immune cells to destroy the target cells and recruit more immune cells to the target cell site within an organism. Under certain conditions, the cell-surface presentation of immunogenic CD8+ epitope-peptides by the MHC class I complex targets simulates the immune system to kill the presenting cell for killing by CD8+ CTL-mediated cytolysis.

For certain embodiments of the cell-targeting molecules of the present invention, upon contacting a cell physically coupled with an extracellular target biomolecule of the molecule's binding region, the cell-targeting molecule is capable of indirectly causing the death of the cell, such as, e.g., via the presentation of one or more T-cell epitopes by the target cell and the subsequent recruitment of a CTLs.

In addition, within a chordate, the presentation by target cells of a CD8+ T-cell epitope cargo delivered by the cell-targeting molecule of the present invention may provide the additional functionality of immuno-stimulation to the local area and/or breaking immuno-tolerance to certain malignant cells in a local area and/or systemically throughout the chordate.

For certain embodiments of the cell-targeting molecules of the present invention, upon contacting a cell physically coupled with an extracellular target biomolecule of the binding region, the cell-targeting molecule of the invention is capable of directly causing the death of the cell, such as, e.g., via the enzymatic activity of a Shiga toxin effector polypeptide or a cytotoxic agent described herein. Under certain conditions, certain cell-targeting molecules of the present invention are cytotoxic because they comprise a catalytically active, Shiga toxin effector polypeptide component which functions so quickly that it prevents the observation of any functional result of delivery of any heterologous, CD8+ T-cell epitope-peptide to the MHC class I presentation pathway by the cell-targeting molecule; however to be encompassed within the scope of the claimed cell-targeting molecules, such a cell-targeting molecule must be capable of delivering a heterologous, CD8+ T-cell epitope-peptide cargo from an extracellular space to the MHC class I presentation pathway of a cell upon exogenous administration.

In addition, a cytotoxic cell-targeting molecule of the present invention that exhibits Shiga toxin effector polypeptide catalytic activity based cytotoxicity may be engineered by the skilled worker using routine methods into enzymatically inactive variants to reduce or eliminate Shiga toxin effector based cytotoxicity. The resulting "inactivated" cell-targeting molecule may or may not still be cytotoxic due to its ability to deliver a heterologous, CD8+ T-cell epitope to the MHC class I system of a target cell and subsequent presentation of the delivered CD8+ T-cell epitope-peptide by MHC class I molecules on the surface of the target cell.

For certain embodiments, the Shiga toxin effector polypeptide component(s) of the cell-targeting molecule of the present invention exhibits low to zero cytotoxicity and thus are referred to herein as "noncytotoxic and/or reduced cytotoxic." For certain embodiments, the cell-targeting molecule of the present invention exhibits low to zero cytotoxicity and may be referred to as "noncytotoxic" and/or "reduced cytotoxic variants." For example, certain embodiments of the cell-targeting molecules of the present invention do not exhibit a significant level of Shiga toxin based cytotoxicity wherein at doses of less than 1,000 nM, 500 nM, 100 nM, 75 nM, 50 nM, there is no significant amount of cell death as compared to the appropriate reference molecule, such as, e.g., as measured by an assay known to the skilled worker and/or described herein. For certain further embodiments, the multivalent cell-targeting molecules of the present invention do not exhibit any toxicity at dosages of 1-100 micrograms (pg) per kilogram (kg) of a mammalian recipient. Reduced-cytotoxic variants may still be cytotoxic at certain concentrations or dosages but exhibit reduced cytotoxicity, such as, e.g., are not capable of exhibiting a significant level of Shiga toxin cytotoxicity in certain situations. Certain cell-targeting molecules of the present invention can be rendered noncytotoxic or reduced cytotoxic, such as, e.g., via the addition of one or more amino acid substitutions known to the skilled worker to inactivate a Shiga toxin A Subunit and/or Shiga toxin effector polypeptide, including exemplary substitutions described herein. The noncytotoxic and reduced cytotoxic variants of the cell-targeting molecules of the present invention may be in certain situations more suitable for delivery a heterologous CD8+ T-cell epitope and/or additional exogenous materials than more cytotoxic variants.

The power of the immune system may be harnessed for therapeutic benefit by interventions which induce infection-like immune reactions specifically toward malignant cells (e.g. tumor cells) and/or malignant tissue loci (e.g. tumors) within a patient specifically such as, e.g., by using a highly immunogenic, foreign epitope from infectious agent in order to locally activate a variety of beneficial immune responses and to specifically mark targeted cells (e.g. tumor cells) as being foreign by inducing an imitation of an infected state. Alternatively, this approach could use highly immunogenic neoepitopes (derived from either infectious or non-infectious agents) or highly immunogenic, non-self epitopes derived from non-infectious agents, such as, e.g., tumor-specific antigens, tumor-associated antigens, and molecules from plants, fungi, etc. Furthermore, it may be possible to dictate which cells or tissues the immune system is stimulated to by the choice of epitope-peptide cargo(s). For example, using endogenous, non-self, tumor antigens (see e.g. Boon T, van der Bruggen P, *J Exp Med* 183: 725-9 (1996); Vonderheide R et al., *Immunity* 10: 673-9 (1999); Van Der Bruggen P et al., *Immunol Rev* 188: 51-64 (2002); Schreurs M et al., *Cancer Immunol Immunother* 54: 703-12 (2005); Adotévi O et al., *Clin Cancer Res* 12: 3158-67 (2006); Valentino M et al., *J Immunol Methods* 373: 111-26 (2011)) to mark targeted cells may induce immune responses to untargeted cells displaying the same or related tumor-epitope whereas using viral epitopes to mark targeted cells in an uninfected cancer patient may limit immune responses to only those cells which have had the epitope delivered and presented in sufficient quantities and for sufficient durations. In addition, it may possible to dictate what type of immune response is induced by the choice of epitope-peptide cargo(s). For example, using endogenous, non-self, tumor antigens to mark targeted cells may induce anti-cancer immune responses to untargeted cells displaying the same or related tumor-epitope whereas using viral epitopes to mark targeted cells in an uninfected cancer patient may limit anti-viral type immune responses to only those cells which have had the epitope delivered and presented in sufficient quantities and for sufficient durations.

The present invention provides immunotherapy methods involving delivering a CD8+ T-cell epitope-peptide cargo to a target cell in a chordate and causing an immune response, the method comprising the step of administering to the chordate a cell-targeting molecule or pharmaceutical composition of the present invention. For certain further embodiments, the immune response is an intercellular immune cell response selected from the group consisting of: CD8+ immune cell secretion of a cytokine(s), CTL induced growth arrest in the target cell, CTL induced necrosis of the target cell, CTL induced apoptosis of the target cell, non-specific cell death in a tissue locus, intermolecular epitope spreading, breaking immunological tolerance to a malignant cell type, and the chordate acquiring persistent immunity to a malignant cell-type (see e.g. Matsushita H et al., *Cancer Immunol Res* 3: 26-36 (2015)). These immune responses can be detected and/or quantified using techniques known to the skilled worker. For example, CD8+ immune cells can release immuno-stimulatory cytokines, such as, e.g., IFN-γ, tumor necrosis factor alpha (TNFα), macrophage inflammatory protein-1 beta (MIP-1β), and interleukins such as IL-17, IL-4, IL-22, and IL-2 (see e.g. Examples, infra; Seder R et al., *Nat Rev Immunol* 8: 247-58 (2008)). IFN-γ can increase MHC class I molecule expression and sensitize neoplastic cells to CTL-mediated cell killing (Vlková V et al., *Oncotarget* 5: 6923-35 (2014)). Inflammatory cytokines can stimulate bystander T-cells that harbor unrelated TCR specificities to the cytokine releasing cell (see e.g. Tough D et al., *Science* 272: 1947-50 (1996)). Activated CTLs can indiscriminately kill cells proximal to epitope-MHC class I complex presenting cell regardless of the proximal cell's present peptide-MHC class I complex repertoire (Wiedemann A et al., *Proc Natl Acad Sci USA* 103: 10985-90 (2006)). Thus, for certain further embodiments, the immune response is an intercellular immune cell response selected from the group consisting of: proximal cell killing mediated by immune cells where the proximal cell is not displaying any CD8+ T-cell epitope-peptide delivered by the cell-targeting molecule of the present invention and regardless of the presence of any extracellular target biomolecule of the binding region of the cell-targeting molecule physically coupled to the proximal cell(s) that is killed.

The presence of non-self epitopes in CTL-lysed cells, whether target cells or cells merely proximal to target cells, can be recognized and targeted as foreign by the immune system, including recognition of non-self epitopes in target cells via the mechanism of intermolecular epitope spreading (see McCluskey J et al., *Immunol Rev* 164: 209-29 (1998); Vanderlugt C et al., *Immunol Rev* 164: 63-72 (1998); Vanderlugt C, Miller S, *Nat Rev Immunol* 2: 85-95 (2002)). Proximal cells may include non-neoplastic cells, such as, e.g., cancer associated fibroblasts, mesenchymal stem cells, tumor-associated endothelial cells, and immature myeloid-derived suppressor cells. For example, a cancer cell may harbor on average 25 to 500 nonsynonymous mutations in coding sequences (see e.g. Fritsch E et al., *Cancer Immunol Res* 2: 522-9 (2014)). Both cancer driver and non-driver mutations are part of the mutational landscape of a cancer cell that corresponds to numerous non-self epitopes per cell and the average tumor may possess ten or more non-self epitopes (see e.g. Segal N et al., *Cancer Res* 68: 889-92 (2008)). For example, mutant forms of the tumor protein p53 can contain non-self epitopes (see e.g. Vigneron N et al., *Cancer Immun* 13: 15 (2013)). In addition, the presence of non-self epitopes, such as mutated self-proteins, can result in the production of memory cells specific to those new epitope(s). Because certain embodiments of the cell-targeting molecules of the present invention may increase dendritic cell sampling at a targeted tissue locus, the probability of cross-priming the immune system with intracellular antigens may be increased (see e.g. Chiang C et al., *Expert Opin Biol Ther* 15: 569-82 (2015)). Thus, as a result of cell-targeting molecule delivery of a heterologous, CD8+ T-cell epitope cargo and MHC class I presentation of that epitope, target cells and other proximal cells containing non-self epitopes can be rejected by the immune system, including via non-self epitopes other than epitopes delivered by a cell-targeting molecule of the invention. Such mechanisms could, e.g., induce antitumor immunity against tumor cells which do not express the extracellular target biomolecule of the binding region of the cell-targeting molecule.

Immune responses which involve cytokine secretion and/or T-cell activation may result in modulation of the immuno-microenvironment of a locus within a chordate. A method of the present invention may be used to alter the microenvironment of a tissue locus within a chordate in order to change the regulatory homeostasis on immune cells, such as, e.g tumor-associated macrophages, T-cells, T helper cells, antigen presenting cells, and natural killer cells.

For certain embodiments, a method of the present invention may be used to enhance anti-tumor cell immunity in a chordate subject and/or to create a persistent anti-tumor immunity in a chordate, such as, e.g., due to the development of memory T-cells and/or alterations to the tumor microenvironment.

Certain embodiments of the cell-targeting molecules of the present invention, or pharmaceutical compositions thereof, can be used to "seed" a locus within a chordate with non-self, CD8+ T-cell epitope-peptide presenting cells in order to stimulate the immune system to police the locus with greater strength and/or to alleviate immuno-inhibitory signals, e.g., anergy inducing signals. In certain further embodiments of this "seeding" method of the present invention, the locus is a tumor mass or infected tissue site. In certain embodiments of this "seeding" method of the present invention, the non-self, CD8+ T-cell epitope-peptide is selected from the group consisting of: peptides not already presented by the target cells of the cell-targeting molecule, peptides not present within any protein expressed by the target cell, peptides not present within the proteome or transcriptome of the target cell, peptides not present in the extracellular microenvironment of the site to be seeded, and peptides not present in the tumor mass or infect tissue site to be targeting.

This "seeding" method functions to label one or more target cells within a chordate with one or more MHC class I presented CD8+ T-cell epitopes (pMHC Is) for intercellular recognition by immune cells and activation of downstream immune responses. By exploiting the cell-internalizing, intracellularly routing, and/or MHC class I epitope delivering functions of the cell-targeting molecules of the present invention, the target cells that display the delivered CD8+ T-cell epitope can be recognized by immunosurveillance mechanisms of the chordate's immune cells and result in intercellular engagement of the presenting target cell by CD8+ T-cells, such as, e.g., CTLs. This "seeding" method of using a cell-targeting molecule of the present invention may stimulate immune cell mediated killing of target cells regardless of whether they are presenting a cell-targeting molecule-delivered T-cell epitope(s), such as, e.g., as a result of intermolecular epitope spreading and/or breaking of immuno-tolerance to the target cell based on presentation of endogenous antigens as opposed to artificially delivered epitopes. This "seeding" method of using a cell-targeting molecule of the present invention may provide a vaccination effect (new epitope(s) exposure) and/or vaccination-booster-dose effect (epitope re-exposure) by inducing adaptive immune responses to cells within the seeded microenvironment, such as, e.g. a tumor mass or infected tissue site, based on the detection of epitopes which are either recognized as foreign by naïve T-cells and/or already recognizable as non-self (i.e. recall antigens) by memory T-cells. This "seeding" method may also induce the breaking of immuno-tolerance to a target cell population, a tumor mass, diseased tissue site, and/or infected tissue site within a chordate, either peripherally or systemically.

The presence of dying or necrotic tumor cells at site or loci within a chordate may result in a localized immune stimulation effect. For example, dying or necrotic tumor cells can release factors, such as, e.g., high mobility group proteins and/or ATP, which in turn can stimulate immunogenic maturation of immune cells. The seeding of a tumor locus may also induce or increase the ectopic expression of ER proteins (e.g., calreticulin) on the plasma membrane of tumor cells which in turn can promote/increase MHC class antigen presentation and phagocytosis of tumor cells at that site.

Certain methods of the present invention involving the seeding of a locus within a chordate with one or more antigenic and/or immunogenic CD8+ T-cell epitopes may be combined with the administration of immunologic adjuvants, whether administered locally or systemically, to stimulate the immune response to certain antigens, such as, e.g., the co-administration of a composition of the present invention with one or more immunologic adjuvants like a cytokine, bacterial product, or plant saponin. Other examples of immunologic adjuvants which may be suitable for use in the methods of the present invention include aluminum salts and oils, such as, e.g., alums, aluminum hydroxide, mineral oils, squalene, paraffin oils, peanut oils, and thimerosal.

Certain methods of the present invention involve promoting immunogenic cross-presentation and/or cross-priming of naïve CD8+ T-cells in a chordate. For certain methods of the present invention, cross-priming occurs as a result of the death, and/or the manner of death, of a target cell caused by a cell-targeting molecule of the present invention such that the exposure of intracellular antigens in the dying or dead target cell to immunosurveillance mechanisms is promoted.

Because multiple, heterologous, CD8+ T-cell epitopes (either as cargos or as embedded or inserted regions of a Shiga toxin effector polypeptide component) may be delivered by a single cell-targeting molecule of the present invention, a single embodiment of the cell-targeting molecule of the present invention may be therapeutically effective in different individual chordates of the same species with different MHC I class molecule variants, such as, e.g., in humans with different HLA alleles. This ability of certain embodiments of the present invention may allow for the combining within a single cell-targeting molecule of different CD8+ T-cell epitope-peptides with different therapeutic effectiveness in different sub-populations of subjects based on MHC class I molecule diversity and polymorphisms. For example, human MHC class I molecules, the HLA proteins, vary among humans based on genetic ancestry, e.g. African (sub-Saharan), Amerindian, Caucasiod, Mongoloid, New Guinean and Australian, or Pacific islander.

Cell-targeting molecules of the present invention which can deliver heterologous, CD8+ T-cell epitopes from CMV antigens may be particularly effective because a majority of the human population has specific sets of CD8+ T-cells primed to react to CMV antigens and are constantly repressing chronic CMV infections to remain asymptomatic for their entire life. In addition, elderly humans may reactive even more quickly and strongly to CMV CD8+ T-cell epitopes due to age-related changes in the adaptive immune system regarding CMV, such as, e.g., a potentially more focused immune surveillance toward CMV and as shown by the composition of the T-cell antigen receptor repertoire and relative CTL levels in more elderly humans (see e.g. Koch S et al., *Ann N Y Acad Sci* 1114: 23-35 (2007); Vescovini R et al., *J Immunol* 184: 3242-9 (2010); Cicin-Sain L et al., *J Immunol* 187: 1722-32 (2011); Fülöp T et al., *Front Immunol* 4: 271 (2013); Pawelec G, *Exp Gerontol* 54: 1-5 (2014)).

C. Selective Cytotoxicity Among Cell-Types

Certain cell-targeting molecules of the present invention have uses in the selective killing of specific target cells in the presence of untargeted, bystander cells. By targeting the delivery of immunogenic, CD8+ T-cell epitope cargos to the MHC class I pathway of target cells, the subsequent presentation of delivered CD8+ T-cell epitopes and the TCR specific regulation of CTL-mediated cytolysis of epitope-presenting target cells can be restricted to preferentially killing selected cell-types in the presence of untargeted cells. In addition, the killing of target cells by the potent cytotoxic activity of various Shiga toxin effector polypeptides can be restricted to preferentially killing target cells with the simultaneous delivery of an immunogenic T-cell epitope cargo and a cytotoxic toxin effector polypeptide.

For certain embodiments, upon administration of the cell-targeting molecule of the present invention to a mixture of cell-types, the cell-targeting molecule is capable of selectively killing those cells which are physically coupled with an extracellular target biomolecule compared to cell-types not physically coupled with an extracellular target biomolecule.

For certain embodiments, upon administration of the cell-targeting molecule of the present invention to a mixture of cell-types, the cytotoxic cell-targeting molecule is capable of selectively killing those cells which are physically coupled with an extracellular target biomolecule compared to cell-types not physically coupled with an extracellular target biomolecule. For certain embodiments, the cytotoxic cell-targeting molecule of the present invention is capable of selectively or preferentially causing the death of a specific cell-type within a mixture of two or more different cell-types. This enables targeting cytotoxic activity to specific cell-types with a high preferentiality, such as a 3-fold cytotoxic effect, over "bystander" cell-types that do not express the target biomolecule. Alternatively, the expression of the target biomolecule of the binding region may be non-exclusive to one cell-type if the target biomolecule is expressed in low enough amounts and/or physically coupled in low amounts with cell-types that are not to be targeted. This enables the targeted cell-killing of specific cell-types with a high preferentiality, such as a 3-fold cytotoxic effect, over "bystander" cell-types that do not express significant amounts of the target biomolecule or are not physically coupled to significant amounts of the target biomolecule.

For certain further embodiments, upon administration of the cytotoxic cell-targeting molecule to two different populations of cell-types, the cytotoxic cell-targeting molecule is capable of causing cell death as defined by the half-maximal cytotoxic concentration ($CD_{50}$) on a population of target cells, whose members express an extracellular target biomolecule of the binding region of the cytotoxic cell-targeting molecule, at a dose at least three-times lower than the $CD_{50}$ dose of the same cytotoxic cell-targeting molecule to a population of cells whose members do not express an extracellular target biomolecule of the binding region of the cytotoxic cell-targeting molecule.

For certain embodiments, the cytotoxic activity of a cell-targeting molecule of the present invention toward populations of cell-types physically coupled with an extracellular target biomolecule is at least 3-fold higher than the cytotoxic activity toward populations of cell-types not physically coupled with any extracellular target biomolecule of the binding region. According to the present invention, selective cytotoxicity may be quantified in terms of the ratio (a/b) of (a) cytotoxicity towards a population of cells of a specific cell-type physically coupled with a target biomolecule of the binding region to (b) cytotoxicity towards a population of cells of a cell-type not physically coupled with a target biomolecule of the binding region. For certain embodiments, the cytotoxicity ratio is indicative of selective cytotoxicity which is at least 3-fold, 5-fold, 10-fold, 15-fold, 20-fold, 25-fold, 30-fold, 40-fold, 50-fold, 75-fold, 100- fold, 250-fold, 500-fold, 750-fold, or 1000-fold higher for populations of cells or cell-types physically coupled with a target biomolecule of the binding region compared to populations of cells or cell-types not physically coupled with a target biomolecule of the binding region.

For certain embodiments, the preferential cell-killing function or selective cytotoxicity of a cell-targeting molecule of the present invention is due to an additional exogenous material (e.g. a cytotoxic material) and/or heterologous, CD8+ T-cell epitope present in the cell-targeting molecule of the present invention and not necessarily a result of the catalytic activity of a Shiga toxin effector polypeptide component of the cell-targeting molecule.

It is important to note that for certain embodiments of the cell-targeting molecules of the present invention, upon administration of the cell-targeting molecule to a chordate, the cell-targeting molecule may cause the death of untargeted cells which are in the vicinity of a target cell and/or which are related to a target cell by sharing a common malignant condition. The presentation of certain T-cell epitopes by target cells within a chordate may result in CTL-mediated killing of the target cells as well as the killing of other cells not presenting the delivered epitope but in the vicinity of epitope-presenting cells. Additionally, the presentation of certain T-cell epitopes by targeted tumor cells within a chordate may result in intermolecular epitope spreading, re-programming of the tumor microenvironment to stimulatory conditions, release of existing immune cells from anergy or removal of de-sensitization to target cells or damaged tissues comprising them, and overcoming the physiological state of tolerance of the subject's immune system to non-self tumor antigens (see Section X. Methods for Using a Cell-Targeting Molecule etc., infra).

Administration of a cell-targeting molecule of the present invention to a chordate may be used in vivo to "clear" specific cell-types, such as, e.g., via immune system action/stimulation as in the form of targeting specific-epitope restricted CTLs to kill targeted cell types and/or other cell types presenting the epitope, whether the epitope was delivered by the cell-targeting molecule or was already present before administration.

D. Delivery of Additional Exogenous Material into the Interior of a Target Cell

In addition to direct cell killing, cell-targeting molecules of the present invention optionally may be used for delivery of additional exogenous materials into the interiors of target cells. The delivery of additional exogenous materials may be used, e.g., for cytotoxic, cytostatic, immune system stimulation, immune cell targeting, information gathering, and/or diagnostic functions. Non-cytotoxic variants of the cytotoxic, cell-targeting molecules of the invention, or optionally toxic variants, may be used to deliver additional exogenous materials to and/or label the interiors of cells physically coupled with an extracellular target biomolecule of the cell-targeting molecule. Various types of cells and/or cell populations which express target biomolecules to at least one cellular surface may be targeted by the cell-targeting molecules of the invention for receiving exogenous materials.

Because the cell-targeting molecules of the present invention, including nontoxic forms thereof, are capable of entering cells physically coupled with an extracellular target biomolecule recognized by its binding region, certain embodiments of the cell-targeting molecules of the present invention may be used to deliver additional exogenous materials into the interior of targeted cell-types. In one sense, the entire cell-targeting molecule of the invention is an exogenous material which will enter the cell; thus, the "additional" exogenous materials are heterologous materials linked to but other than the core cell-targeting molecule itself. Non-toxic, cell-targeting molecules of the present invention which comprise a heterologous, CD8+ T-cell epitope-peptide(s) which does not stimulate CTL-mediated cell killing in certain situations may still be useful for delivering a "benign" CD8+ T-cell-epitope-peptide which does not result in cell-killing upon MHC class I presentation but allows for information gathering, such as, e.g., regarding immune system function in an individual, MHC class I variant expression, and operability of the MHC class I system in a certain cell.

"Additional exogenous material" as used herein refers to one or more molecules, often not generally present within a native target cell and/or present at undesirably low levels, where the proteins of the present invention can be used to specifically transport such material to the interior of a cell. Non-limiting examples of additional exogenous materials are cytotoxic agents, peptides, polypeptides, proteins, polynucleotides, detection promoting agents, and small molecule chemotherapeutic agents.

In certain embodiments of the proteins of the present invention for delivery of additional exogenous material, the additional exogenous material is a cytotoxic agent, such as, e.g., a small molecule chemotherapeutic agent, cytotoxic antibiotic, alkylating agent, antimetabolite, topoisomerase inhibitor, and/or tubulin inhibitor. Non-limiting examples of cytotoxic agents include aziridines, cisplatins, tetrazines, procarbazine, hexamethylmelamine, vinca alkaloids, taxanes, camptothecins, etoposide, doxorubicin, mitoxantrone, teniposide, novobiocin, aclarubicin, anthracyclines, actinomycin, bleomycin, plicamycin, mitomycin, daunorubicin, epirubicin, idarubicin, dolastatins, maytansines, docetaxel, adriamycin, calicheamicin, auristatins, pyrrolobenzodiazepine, carboplatin, 5-fluorouracil (5-FU), capecitabine, mitomycin C, paclitaxel, 1,3-Bis(2-chloroethyl)-1-nitrosourea (BCNU), rifampicin, cisplatin, methotrexate, and gemcitabine.

In certain embodiments, the additional exogenous material comprises a protein or polypeptide comprising an enzyme. In certain other embodiments, the additional exogenous material is a nucleic acid, such as, e.g. a ribonucleic acid that functions as a small inhibiting RNA (siRNA) or microRNA (miRNA). In certain embodiments, the additional exogenous material is an antigen, such as antigens derived from bacterial proteins, viral proteins, proteins mutated in cancer, proteins aberrantly expressed in cancer, or T-cell complementary determining regions. For example, exogenous materials include antigens, such as those characteristic of antigen-presenting cells infected by bacteria, and T-cell complementary determining regions capable of functioning as exogenous antigens. Additional examples of exogenous materials include polypeptides and proteins larger than an antigenic peptide, such as enzymes.

In certain embodiments, the additional exogenous material comprises a proapoptotic peptide, polypeptide, or protein, such as, e.g., BCL-2, caspases (e.g. fragments of caspase-3 or caspase-6), cytochromes, granzyme B, apoptosis-inducing factor (AIF), BAX, tBid (truncated Bid), and proapoptotic fragments or derivatives thereof (see e.g., Ellerby H et al., *Nat Med* 5: 1032-8 (1999); Mai J et al., *Cancer Res* 61: 7709-12 (2001); Jia L et al., *Cancer Res* 63: 3257-62 (2003); Liu Y et al., *Mol Cancer Ther* 2: 1341-50 (2003); Perea S et al., *Cancer Res* 64: 7127-9 (2004); Xu Y et al., *J Immunol* 173: 61-7 (2004); Dalken B et al., *Cell Death Differ* 13: 576-85 (2006); Wang T et al., *Cancer Res*

67: 11830-9 (2007); Kwon M et al., *Mol Cancer Ther* 7: 1514-22 (2008); Shan L et al., *Cancer Biol Ther* 11: 1717-22 (2008); Qiu X et al., *Mol Cancer Ther* 7: 1890-9 (2008); Wang F et al., *Clin Cancer Res* 16: 2284-94 (2010); Kim J et al., *J Virol* 85: 1507-16 (2011)).

Certain reduced-activity Shiga toxin effector polypeptides may be particularly useful for delivering an additional exogenous material to certain intracellular locations or subcellular compartments of target cells.

E. Information Gathering for Diagnostic Functions

The cell-targeting molecules of the present invention may be used for information gathering functions. Certain embodiments of the cell-targeting molecules of the present invention may be used for imaging of specific pMHC I presenting cells using antibodies specific to pMHC Is that recognize a heterologous, CD8+ T-cell epitope-peptide (delivered by a cell-targeting molecule of the present invention) complexed with a MHC class I molecule on a cell surface. In addition, certain cell-targeting molecules of the present invention have uses in the in vitro and/or in vivo detection of specific cells, cell-types, and/or cell populations. In certain embodiments, the cell-targeting molecules described herein are used for both diagnosis and treatment, or for diagnosis alone.

The ability to conjugate detection promoting agents known in the art to various cell-targeting molecules of the present invention provides useful compositions for the detection of cancer, tumor, growth abnormality, immune, and infected cells. These diagnostic embodiments of the cell-targeting molecules of the invention may be used for information gathering via various imaging techniques and assays known in the art. For example, diagnostic embodiments of the cell-targeting molecules of the invention may be used for information gathering via imaging of intracellular organelles (e.g. endocytotic, Golgi, endoplasmic reticulum, and cytosolic compartments) of individual cancer cells, immune cells, or infected cells in a patient or biopsy sample.

Various types of information may be gathered using the diagnostic embodiments of the cell-targeting molecules of the invention whether for diagnostic uses or other uses. This information may be useful, for example, in diagnosing neoplastic cell subtypes, determining MHC class I pathway and/or TAP system functionality in specific cell-types, determining changes to MHC class I pathway and/or TAP system functionality in specific cell-types over time, determining therapeutic susceptibilities of a patient's disease, assaying the progression of antineoplastic therapies over time, assaying the progression of immuno-modulatory therapies over time, assaying the progression of antimicrobial therapies over time, evaluating the presence of infected cells in transplantation materials, evaluating the presence of unwanted cell-types in transplantation materials, and/or evaluating the presence of residual tumor cells after surgical excision of a tumor mass.

For example, subpopulations of patients might be ascertained using information gathered using the diagnostic variants of the cell-targeting molecules of the invention, and then individual patients could be categorized into subpopulations based on their unique characteristic(s) revealed using those diagnostic embodiments. For example, the effectiveness of specific pharmaceuticals or therapies might be one type of criterion used to define a patient subpopulation. For example, a nontoxic diagnostic variant of a particular cytotoxic, cell-targeting molecule of the invention may be used to differentiate which patients are in a class or subpopulation of patients predicted to respond positively to a cytotoxic variant of the same cell-targeting molecule of the invention. Accordingly, associated methods for patient identification, patient stratification, and diagnosis using cell-targeting molecules of the present invention, including non-toxic variants of cytotoxic, cell-targeting molecules of the present invention, are considered to be within the scope of the present invention.

IV. Variations in the Polypeptide Sequence of the Protein Components of the Cell-Targeting Molecules of the Present Invention The skilled worker will recognize that variations may be made to the cell-targeting molecules of the present invention described above, and polynucleotides encoding any of the former, without diminishing their biological activities, e.g., by maintaining the overall structure and function of the cell-targeting molecules in delivering their heterologous, CD8+ T-cell epitope-peptide cargos to the MHC class I presentation pathways of target cells after exogenous administration to the target cells. For example, some modifications may facilitate expression, facilitate purification, improve pharmacokinetic properties, and/or improve immunogenicity. Such modifications are well known to the skilled worker and include, for example, a methionine added at the amino terminus to provide an initiation site, additional amino acids placed on either terminus to create conveniently located restriction sites or termination codons, and biochemical affinity tags fused to either terminus to provide for convenient detection and/or purification. A common modification to improve the immunogenicity of a polypeptide is to remove, after the production of the polypeptide, the starting methionine residue, which may be formylated during production in a bacterial host system, because, e.g., the presence of N-formylmethionine (fMet) might induce undesirable immune responses in chordates.

In certain variations of embodiments of the cell-targeting molecules of the invention, certain cell-targeting functionality of the binding region must be maintained so that the specificity and selectivity of target biomolecule binding is significantly preserved. In certain variations of embodiments of the cell-targeting molecules of the invention, certain biological activities of the Shiga toxin effector polypeptide may need to be preserved, e.g., inducing cellular internalization, intracellular routing to certain subcellular compartments (like compartments competent for entry into the MHC class I pathway), and/or ability to deliver exogenous material(s) to certain subcellular compartments of target cells.

Also contemplated herein is the inclusion of additional amino acid residues at the amino and/or carboxy termini, such as sequences for biochemical tags or other moieties. The additional amino acid residues may be used for various purposes including, e.g., to facilitate cloning, expression, post-translational modification, synthesis, purification, detection, and/or administration. Non-limiting examples of biochemical tags and moieties are: chitin binding protein domains, enteropeptidase cleavage sites, Factor Xa cleavage sites, FlAsH tags, FLAG tags, green fluorescent proteins (GFP), glutathione-S-transferase moieties, HA tags, maltose binding protein domains, myc tags, polyhistidine tags, ReAsH tags, strep-tags, strep-tag II, TEV protease sites, thioredoxin domains, thrombin cleavage site, and V5 epitope tags.

In certain of the above embodiments, the protein sequence of the cell-targeting molecules of the present invention, or polypeptide components thereof, are varied by one or more conservative amino acid substitutions introduced into the protein or polypeptide component(s) as long as the cell-targeting molecule retains the ability to deliver its heterologous, CD8+ T-cell epitope-peptide cargo to a MHC class I presentation system of a target cell after exogenous administration to the target cells such that the delivery and/or cell-surface MHC class I presentation of the delivered CD8+ T-cell epitope is detectable using an assay known to the skilled worker and/or described herein.

As used herein, the term "conservative substitution" denotes that one or more amino acids are replaced by another, biologically similar amino acid residue. Examples include substitution of amino acid residues with similar characteristics, e.g. small amino acids, acidic amino acids, polar amino acids, basic amino acids, hydrophobic amino acids, and aromatic amino acids (see, for example, Table B, infra). An example of a conservative substitution with a residue normally not found in endogenous, mammalian peptides and proteins is the conservative substitution of an arginine or lysine residue with, for example, ornithine, canavanine, aminoethylcysteine, or another basic amino acid. For further information concerning phenotypically silent substitutions in peptides and proteins see, e.g., Bowie J et al., *Science* 247: 1306-10 (1990).

TABLE B

Examples of Conservative Amino Acid Substitutions

| I | II | III | IV | V | VI | VII | VIII | IX | X | XI | XII | XIII | XIV |
|---|----|-----|----|---|----|----|------|----|---|----|-----|------|-----|
| A | D | H | C | F | N | A | C | F | A | C | A | A | D |
| G | E | K | I | W | Q | G | M | H | C | D | C | C | E |
| P | Q | R | L | Y | S | I | P | W | F | E | D | D | G |
| S | N |   | M | T | L |   |   | Y | G | H | G | E | K |
| T |   |   | V |   | V |   |   |   | H | K | N | G | P |
|   |   |   |   |   |   |   |   |   | I | N | P | H | Q |
|   |   |   |   |   |   |   |   |   | L | Q | S | K | R |
|   |   |   |   |   |   |   |   |   | M | R | T | N | S |
|   |   |   |   |   |   |   |   |   | R | S | V | Q | T |
|   |   |   |   |   |   |   |   |   | T | T |   | R |   |
|   |   |   |   |   |   |   |   |   | V |   |   | S |   |
|   |   |   |   |   |   |   |   |   | W |   |   | P |   |
|   |   |   |   |   |   |   |   |   | Y |   |   | T |   |

In the conservative substitution scheme in Table B above, exemplary conservative substitutions of amino acids are grouped by physicochemical properties—I: neutral, hydrophilic; II: acids and amides; III: basic; IV: hydrophobic; V: aromatic, bulky amino acids, VI hydrophilic uncharged, VII aliphatic uncharged, VIII non-polar uncharged, IX cycloalkenyl-associated, X hydrophobic, XI polar, XII small, XIII turn-permitting, and XIV flexible. For example, conservative amino acid substitutions include the following: 1) S may be substituted for C; 2) M or L may be substituted for F; 3) Y may be substituted for M; 4) Q or E may be substituted for K; 5) N or Q may be substituted for H; and 6) H may be substituted for N.

In certain embodiments, the cell-targeting molecules of the present invention (e.g. cell-targeting fusion proteins) may comprise functional fragments or variants of a polypeptide region of the invention that have, at most, 20, 15, 10, 9, 8, 7, 6, 5, 4, 3, 2, or 1 amino acid residue substitutions compared to a polypeptide sequence recited herein, as long as the cell-targeting molecule comprising it is capable of delivering its heterologous, CD8+ T-cell epitope-peptide cargo to a MHC class I presentation pathway of a target cell. Variants of the cell-targeting molecules of the invention are within the scope of the present invention as a result of changing a polypeptide component of the cell-targeting protein of the invention by altering one or more amino acids or deleting or inserting one or more amino acids, such as within the binding region or the Shiga toxin effector polypeptide component, in order to achieve desired properties, such as changed cytotoxicity, changed cytostatic effects, changed immunogenicity, and/or changed serum half-life. A cell-targeting molecule of the invention, or polypeptide component thereof, may further be with or without a signal sequence.

Accordingly, in certain embodiments, the binding region of cell-targeting molecules of the present invention comprises or consists essentially of amino acid sequences having at least 80%, 85%, 90%, 95%, 97%, 98%, 99%, 99.5% or 99.7% overall sequence identity to a binding region recited herein or otherwise already known when compared to an aligned sequence in which the alignment is done by a computer homology program known in the art, as long as the binding region exhibits, as a component of the cell-targeting molecule, a reasonable amount of extracellular target biomolecule binding specificity and affinity, such as, e.g. by exhibiting a $K_D$ to the target biomolecule of $10^{-5}$ to $10^{-12}$ moles/liter.

In certain embodiments, the Shiga toxin effector polypeptide region of cell-targeting molecules of the present invention comprises or consists essentially of amino acid sequences having at least 55%, 60%, 65%, 70%, 75%, 80%, 85%, 90%, 95%, 97%, 98%, 99%, 99.5% or 99.7% overall sequence identity to a naturally occurring toxin, such as, e.g., Shiga toxin A Subunit, such as any one of SEQ ID NOs: 1-18, when compared to an aligned sequence in which the alignment is done by a computer homology program known in the art, as long as the Shiga toxin effector polypeptide exhibits, as a component of the cell-targeting molecule, the required level of the Shiga toxin effector function(s) related to intracellular delivery of a the cell-targeting molecule's heterologous, CD8+ T-cell epitope-peptide cargo to the MHC class I presentation pathway of at least one target cell-type.

In certain embodiments, the Shiga toxin effector polypeptide components of the cell-targeting molecules of the present invention may be altered to change the enzymatic activity and/or cytotoxicity of the Shiga toxin effector polypeptide, as long as the Shiga toxin effector polypeptide exhibits, as a component of the cell-targeting molecule, the required level of the Shiga toxin effector function(s) related to intracellular delivery of a the cell-targeting molecule's CD8+ T-cell epitope-peptide cargo to the MHC class I presentation pathway of at least one target cell-type. This change may or may not result in a change in the cytotoxicity of the Shiga toxin effector polypeptide or cell-targeting molecule of which the altered Shiga toxin effector polypeptide is a component. Both Shiga toxin enzymatic activity and cytotoxicity may be altered, reduced, or eliminated by mutation or truncation. Possible alterations include mutations to the Shiga toxin effector polypeptide selected from the group consisting of: a truncation, deletion, inversion, insertion, rearrangement, and substitution as long as the Shiga toxin effector polypeptide retains, as a component of the cell-targeting molecule, the required level of the Shiga toxin effector function(s) related to intracellular delivery of a the cell-targeting molecule's heterologous, CD8+ T-cell epitope-peptide cargo to the MHC class I presentation pathway of at least one target cell-type.

The cytotoxicity of the A Subunits of members of the Shiga toxin family may be altered, reduced, or eliminated by mutation or truncation. The cell-targeting molecules of the present invention each comprise a Shiga toxin A Subunit effector polypeptide region which provide each cell-targeting molecule the ability to deliver the cell-targeting molecule's heterologous, CD8+ T-cell epitope-peptide cargo to the MHC class I presentation pathway of at least one target cell-type regardless of Shiga toxin effector polypeptide catalytic activity. As shown in the Examples below, the catalytic activity and cytotoxicity of Shiga toxin effector polypeptides may be uncoupled from other Shiga toxin effector functions required to provide a cell-targeting molecule of the present invention with the ability to deliver a fused, heterologous, CD8+ T-cell epitope to the MHC class I presentation pathway of a target cell-type. Thus in certain embodiments of the cell-targeting molecules of the present invention, the Shiga toxin effector polypeptide component is engineered to exhibit diminished or abolished Shiga toxin cytotoxicity, such as, e.g., due to the presence of amino acid residue mutations relative to a wild-type Shiga toxin A Subunit in one or more key residues involved in enzymatic activity. This provides cell-targeting molecules of the invention which do not kill target cells directly via the Shiga toxin function of cytotoxicity. Such cell-targeting molecules of the invention, which lack cytotoxic Shiga toxin effector polypeptide regions, are useful for effectuating 1) cell-killing via the delivery of a heterologous, CD8+ T-cell epitope-peptide for MHC class I presentation by a target cell, 2) the stimulation of desirable, intercellular immune cell response(s) to a target cells as a result of the delivery of a heterologous, CD8+ T-cell epitope-peptide to the MHC class I system of target cells, and/or 3) the labeling of target cells with specific CD8+ T-cell epitope-peptide/MHC class I molecule complexes when the target cell is not defective in the machinery required to do so.

The catalytic and/or cytotoxic activity of the A Subunits of members of the Shiga toxin family may be diminished or eliminated by mutation or truncation. The most critical residues for enzymatic activity and/or cytotoxicity in the Shiga toxin A Subunits have been mapped to the following residue-positions: aspargine-75, tyrosine-77, glutamate-167, arginine-170, arginine-176, and tryptophan-203 among others (Di R et al., *Toxicon* 57: 525-39 (2011)). In particular, a double-mutant construct of Stx2A containing glutamate-E167-to-lysine and arginine-176-to-lysine mutations was completely inactivated; whereas, many single mutations in Stx1 and Stx2 showed a 10-fold reduction in cytotoxicity. The positions labeled tyrosine-77, glutamate-167, arginine-170, tyrosine-114, and tryptophan-203 have been shown to be important for the catalytic activity of Stx, Stx1, and Stx2 (Hovde C et al., *Proc Natl Acad Sci USA* 85: 2568-72 (1988); Deresiewicz R et al., *Biochemistry* 31: 3272-80 (1992); Deresiewicz R et al., *Mol Gen Genet* 241: 467-73 (1993); Ohmura M et al., *Microb Pathog* 15: 169-76 (1993); Cao C et al., *Microbiol Immunol* 38: 441-7 (1994); Suhan M, Hovde C, *Infect Immun* 66: 5252-9 (1998)). Mutating both glutamate-167 and arginine-170 eliminated the enzymatic activity of Slt-I A1 in a cell-free ribosome inactivation assay (LaPointe P et al., *J Biol Chem* 280: 23310-18 (2005)). In another approach using de novo expression of Slt-I A1 in the endoplasmic reticulum, mutating both glutamate-167 and arginine-170 eliminated Slt-I A1 fragment cytotoxicity at that expression level (LaPointe P et al., *J Biol Chem* 280: 23310-18 (2005)).

Further, truncation of Stx1A to 1-239 or 1-240 reduced its cytotoxicity, and similarly, truncation of Stx2A to a conserved hydrophobic residue reduced its cytotoxicity. The most critical residues for binding eukaryotic ribosomes and/or eukaryotic ribosome inhibition in the Shiga toxin A Subunit have been mapped to the following residue-positions arginine-172, arginine-176, arginine-179, arginine-188, tyrosine-189, valine-191, and leucine-233 among others (McCluskey A et al., *PLoS One* 7: e31191 (2012)).

In certain embodiments of the cell-targeting molecules of the invention, the Shiga toxin A Subunit effector polypeptide derived from or comprising a component derived from a Shiga toxin A Subunit (e.g. any one of SEQ ID NOs: 1-18) comprises an alteration from a wild-type Shiga toxin, polypeptide sequence, such as, e.g., one or more of the following amino acid residue substitution(s): asparagine at position 75, tyrosine at position 77, tyrosine at position 114, glutamate at position 167, arginine at position 170, arginine at position 176, tryptophan at position 202, and/or substitution of the tryptophan at position 203. Examples of such substitutions will be known to the skilled worker based on the prior art, such as asparagine at position 75 to alanine, tyrosine at position 77 to serine, substitution of the tyrosine at position 114 to alanine, substitution of the glutamate at position 167 to aspartate, substitution of the arginine at position 170 to alanine, substitution of the arginine at position 176 to lysine, and/or substitution of the tryptophan at position 203 to alanine. Other mutations which either enhance or reduce Shiga toxin A Subunit effector polypeptide enzymatic activity and/or cytotoxicity are within the scope of the present invention and may be determined using well known techniques and assays disclosed herein.

In certain embodiments, the cell-targeting molecule of the present invention, or a proteinaceous component thereof, comprises one or more post-translational modifications, such as, e.g., phosphorylation, acetylation, glycosylation, amidation, hydroxylation, and/or methylation (see e.g. Nagata K et al., *Bioinformatics* 30: 1681-9 (2014)).

In certain embodiments of the cell-targeting molecules of the present invention, one or more amino acid residues may be mutated, inserted, or deleted in order to increase the enzymatic activity of the Shiga toxin effector polypeptide region as long as the cell-targeting molecule is capable of delivering its heterologous, CD8+ T-cell epitope-peptide cargo to the MHC class I presentation pathway of a target cell. For example, mutating residue-position alanine-231 in Stx1A to glutamate increased its enzymatic activity in vitro (Suhan M, Hovde C, *Infect Immun* 66: 5252-9 (1998)).

The cell-targeting molecules of the present invention may optionally be conjugated to one or more additional agents, which may include therapeutic and/or diagnostic agents known in the art, including such agents as described herein.

V. Production, Manufacture, and Purification of Cell-Targeting Molecules of the Present Invention The cell-targeting molecules of the present invention may be produced using biochemical engineering techniques well known to those of skill in the art. For example, cell-targeting molecules of the invention and/or protein components thereof may be manufactured by standard synthetic methods, by use of recombinant expression systems, or by any other suitable method. Thus, certain cell-targeting molecules of the present invention, and protein components thereof, may be synthesized in a number of ways, including, e.g. methods comprising: (1) synthesizing a polypeptide or polypeptide component of a protein using standard solid-phase or liquid-phase methodology, either stepwise or by fragment assembly, and isolating and purifying the final polypeptide or protein compound product; (2) expressing a polynucleotide that encodes a polypeptide or polypeptide component of a cell-targeting molecule of the invention in a host cell and recovering the expression product from the host cell or host cell culture; or (3) cell-free in vitro expression of a polynucleotide encoding a polypeptide or polypeptide component of a cell-targeting molecule of the invention, and recovering the expression product; or by any combination of the methods of (1), (2) or (3) to obtain fragments of the peptide component, subsequently joining (e.g. ligating) the fragments to obtain the peptide component, and recovering the peptide component. For example, polypeptide and/or peptide components may be ligated together using coupling reagents, such as, e.g., N,N'-dicyclohexylcarbodiimide and N-ethyl-5-phenyl-isoxazolium-3'-sulfonate (Woodward's reagent K).

It may be preferable to synthesize a cell-targeting molecule or a proteinaceous component of a cell-targeting molecule of the invention by means of solid-phase or liquid-phase peptide synthesis. Cell-targeting molecules of the invention and components thereof may suitably be manufactured by standard synthetic methods. Thus, peptides may be synthesized by, e.g. methods comprising synthesizing the peptide by standard solid-phase or liquid-phase methodology, either stepwise or by fragment assembly, and isolating and purifying the final peptide product. In this context, reference may be made to WO1998/11125 or, inter alia, Fields G et al., *Principles and Practice of Solid-Phase Peptide Synthesis* (Synthetic Peptides, Grant G, ed., Oxford University Press, U.K., 2nd ed., 2002) and the synthesis examples therein.

Cell-targeting molecules of the present invention which are fusion proteins may be prepared (produced and purified) using recombinant techniques well known in the art. In general, methods for preparing proteins by culturing host cells transformed or transfected with a vector comprising the encoding polynucleotide and recovering the protein from cell culture are described in, e.g. Sambrook J et al., *Molecular Cloning: A Laboratory Manual* (Cold Spring Harbor Laboratory Press, NY, U.S., 1989); Dieffenbach C et al., *PCR Primer: A Laboratory Manual* (Cold Spring Harbor Laboratory Press, N.Y., U.S., 1995). Any suitable host cell may be used to produce a cell-targeting protein of the present invention or a proteinaceous component of a cell-targeting molecule of the present invention. Host cells may be cells stably or transiently transfected, transformed, transduced or infected with one or more expression vectors which drive expression of a cell-targeting molecule of the present invention and/or protein component thereof. In addition, a cell-targeting molecule of the present invention may be produced by modifying the polynucleotide encoding the cell-targeting protein of the present invention or a proteinaceous component of a cell-targeting molecule of the present invention that result in altering one or more amino acids or deleting or inserting one or more amino acids in order to achieve desired properties, such as changed cytotoxicity, changed cytostatic effects, and/or changed serum half-life.

There are a wide variety of expression systems which may be chosen to produce a cell-targeting molecule of the present invention. For example, host organisms for expression of cell-targeting proteins of the invention include prokaryotes, such as *E. coli* and *B. subtilis*, eukaryotic cells, such as yeast and filamentous fungi (like *S. cerevisiae, P. pastoris, A. awamori,* and *K. lactis*), algae (like *C. reinhardtii*), insect cell lines, mammalian cells (like CHO cells), plant cell lines, and eukaryotic organisms such as transgenic plants (like *A. thaliana* and *N. benthamiana*) (see e.g. Zarschler K et al., *Microbial Cell Factories* 12: 97 (2013)).

Accordingly, the present invention also provides methods for producing a cell-targeting molecule of the present invention according to above recited methods and using (i) a polynucleotide encoding part or all of a molecule of the invention or a polypeptide component of a cell-targeting molecule of the present invention, (ii) an expression vector comprising at least one polynucleotide of the invention capable of encoding part or all of a molecule of the invention or a polypeptide component thereof when introduced into a suitable host cell or cell-free expression system, and/or (iii) a host cell comprising a polynucleotide or expression vector of the invention.

When a protein is expressed using recombinant techniques in a host cell or cell-free system, it is advantageous to separate (or purify) the desired protein away from other components, such as host cell factors, in order to obtain preparations that are of high purity or are substantially homogeneous. Purification can be accomplished by methods well known in the art, such as centrifugation techniques, extraction techniques, chromatographic and fractionation techniques (e.g. size separation by gel filtration, charge separation by ion-exchange column, hydrophobic interaction chromatography, reverse phase chromatography, chromatography on silica or cation-exchange resins such as DEAE and the like, chromatofocusing, and Protein A Sepharose chromatography to remove contaminants), and precipitation techniques (e.g. ethanol precipitation or ammonium sulfate precipitation). Any number of biochemical purification techniques may be used to increase the purity of a cell-targeting molecule of the present invention. In certain embodiments, the cell-targeting molecules of the invention may optionally be purified in homo-multimeric forms (e.g. a stable complex of two or more identical cell-targeting molecules of the invention) or in hetero-multimeric forms (e.g. a stable complex of two or more non-identical cell-targeting molecules of the invention).

In the Examples below are descriptions of non-limiting examples of methods for producing a cell-targeting molecule of the present invention or polypeptide component thereof, as well as specific but non-limiting aspects of production for exemplary cell-targeting molecules of the present invention.

VI. Pharmaceutical and Diagnostic Compositions Comprising a Cell-Targeting Molecule of the Present Invention The present invention provides cell-targeting molecules for use, alone or in combination with one or more additional therapeutic agents, in a pharmaceutical composition, for treatment or prophylaxis of conditions, diseases, disorders, or symptoms described in further detail below (e.g. cancers, malignant tumors, non-malignant tumors, growth abnormalities, immune disorders, and microbial infections). The present invention further provides pharmaceutical compositions comprising a cell-targeting molecule of the invention, or a pharmaceutically acceptable salt or solvate thereof, according to the invention, together with at least one pharmaceutically acceptable carrier, excipient, or vehicle. In certain embodiments, the pharmaceutical composition of the present invention may comprise homo-multimeric and/or hetero-multimeric forms of the cell-targeting molecules of the invention. The pharmaceutical compositions will be useful in methods of treating, ameliorating, or preventing a disease, condition, disorder, or symptom described in further detail below. Each such disease, condition, disorder, or symptom is envisioned to be a separate embodiment with respect to uses of a pharmaceutical composition according to the invention. The invention further provides pharmaceutical compositions for use in at least one method of treatment according to the invention, as described in more detail below.

As used herein, the terms "patient" and "subject" are used interchangeably to refer to any organism, commonly vertebrates such as humans and animals, which presents symptoms, signs, and/or indications of at least one disease, disorder, or condition. These terms include mammals such as the non-limiting examples of primates, livestock animals (e.g. cattle, horses, pigs, sheep, goats, etc.), companion animals (e.g. cats, dogs, etc.) and laboratory animals (e.g. mice, rabbits, rats, etc.).

As used herein, "treat," "treating," or "treatment" and grammatical variants thereof refer to an approach for obtaining beneficial or desired clinical results. The terms may refer to slowing the onset or rate of development of a condition, disorder or disease, reducing or alleviating symptoms associated with it, generating a complete or partial regression of the condition, or some combination of any of the above. For the purposes of this invention, beneficial or desired clinical results include, but are not limited to, reduction or alleviation of symptoms, diminishment of extent of disease, stabilization (e.g. not worsening) of state of disease, delay or slowing of disease progression, amelioration or palliation of the disease state, and remission (whether partial or total), whether detectable or undetectable. "Treat," "treating," or "treatment" can also mean prolonging survival relative to expected survival time if not receiving treatment. A subject (e.g. a human) in need of treatment may thus be a subject already afflicted with the disease or disorder in question. The terms "treat," "treating," or "treatment" includes inhibition or reduction of an increase in severity of a pathological state or symptoms relative to the absence of treatment, and is not necessarily meant to imply complete cessation of the relevant disease, disorder, or condition. With regard to tumors and/or cancers, treatment includes reductions in overall tumor burden and/or individual tumor size.

As used herein, the terms "prevent," "preventing," "prevention" and grammatical variants thereof refer to an approach for preventing the development of, or altering the pathology of, a condition, disease, or disorder. Accordingly, "prevention" may refer to prophylactic or preventive measures. For the purposes of this invention, beneficial or desired clinical results include, but are not limited to, prevention or slowing of symptoms, progression or development of a disease, whether detectable or undetectable. A subject (e.g. a human) in need of prevention may thus be a subject not yet afflicted with the disease or disorder in question. The term "prevention" includes slowing the onset of disease relative to the absence of treatment, and is not necessarily meant to imply permanent prevention of the relevant disease, disorder or condition. Thus "preventing" or "prevention" of a condition may in certain contexts refer to reducing the risk of developing the condition, or preventing or delaying the development of symptoms associated with the condition.

As used herein, an "effective amount" or "therapeutically effective amount" is an amount or dose of a composition (e.g. a therapeutic composition or agent) that produces at least one desired therapeutic effect in a subject, such as preventing or treating a target condition or beneficially alleviating a symptom associated with the condition. The most desirable therapeutically effective amount is an amount that will produce a desired efficacy of a particular treatment selected by one of skill in the art for a given subject in need thereof. This amount will vary depending upon a variety of factors understood by the skilled worker, including but not limited to the characteristics of the therapeutic compound (including activity, pharmacokinetics, pharmacodynamics, and bioavailability), the physiological condition of the subject (including age, sex, disease type, disease stage, general physical condition, responsiveness to a given dosage, and type of medication), the nature of the pharmaceutically acceptable carrier or carriers in the formulation, and the route of administration. One skilled in the clinical and pharmacological arts will be able to determine a therapeutically effective amount through routine experimentation, namely by monitoring a subject's response to administration of a compound and adjusting the dosage accordingly (see e.g. *Remington: The Science and Practice of Pharmacy* (Gennaro A, ed., Mack Publishing Co., Easton, Pa., U.S., 19th ed., 1995)).

A pharmaceutical composition of the present invention optionally includes a pharmaceutically acceptable excipient. Non-limiting examples of pharmaceutically acceptable excipients include arginine, arginine sulfate, citric acid, glycerol, hydrochloric acid, mannitol, methionine, polysorbate, sodium chloride, sodium citrate, sodium hydroxide, sorbitol, sucrose, trehalose, and/or water. In certain embodiments, the pharmaceutical composition of the present invention comprises an aqueous carrier and at least one pharmaceutically acceptable excipient. In certain other embodiments, the pharmaceutical composition of the present invention comprises a salt and/or powder, such as, e.g. a freeze-dried, lyophilized, dehydrated, and/or cryodesiccated composition comprising at least one pharmaceutically acceptable excipient. In certain embodiments of the pharmaceutical composition of the present invention, the excipient functions to reduce and/or limit the immunogenicity and/or immunogenic potential of the cell-targeting molecule, such as, e.g. after administration and/or repeated administration to a mammal.

The pharmaceutical compositions of the present invention may comprise one or more adjuvants such as a buffer, tonicity-adjusting agent (isotonic agent), antioxidant, surfactant, stabilizer, preservative, emulsifying agent, cryoprotective agent, wetting agent, and/or dispersing agent or other additives well known to those of skill in the art, such as, e.g. a binding agent. In certain embodiments, the pharmaceutical composition of the present invention comprises an aqueous carrier and a pharmaceutically acceptable adjuvant or other additive. In certain other embodiments, the pharmaceutical composition of the present invention comprises a salt and/or powder, such as, e.g. a freeze-dried, lyophilized, dehydrated, and/or cryodesiccated composition comprising a pharmaceutically acceptable adjuvant or other additive. Non-limiting examples of pharmaceutically suitable stabilizers include human albumin and polysorbates such as, e.g., polyoxyethylene (20) sorbitan monolaurate (polysorbate 20), polyoxyethylene (20) sorbitan monopalmitate (polysorbate 40), polyoxyethylene (20) sorbitan monostearate (polysorbate 60), and (polyoxyethylene (20) sorbitan monooleate (polysorbate 80).

The pharmaceutical composition of the present invention may comprise one or more pharmaceutically acceptable buffers. Non-limiting examples of suitable buffers include acetate, citrate, citric acid, histidine, phosphate, sodium citrate, and succinate buffers. In certain embodiments, the pharmaceutical composition of the present invention comprises an aqueous carrier comprising a pharmaceutically acceptable buffer. In certain other embodiments, the pharmaceutical composition of the present invention comprises a salt and/or powder, such as, e.g. a freeze-dried, lyophilized, dehydrated, and/or cryodesiccated composition comprising a pharmaceutically acceptable buffer.

The pharmaceutical composition of the present invention may comprise one or more pharmaceutically acceptable isotonic agents or tonicity-adjusting agents. Non-limiting examples of suitable isotonic agents include sugars (e.g. dextrose), sugar alcohols, sodium chloride, and the like. Further examples of suitable sugars include disaccharides like sucrose and trehalose. Exemplary, pharmaceutically acceptable sugar alcohols include glycerol, mannitol, and sorbitol. In certain embodiments, the pharmaceutical composition of the present invention comprises an aqueous carrier and a pharmaceutically acceptable isotonic agent. In certain other embodiments, the pharmaceutical composition of the present invention comprises a salt and/or powder, such as, e.g. a freeze-dried, lyophilized, dehydrated, and/or cryodesiccated composition comprising a pharmaceutically acceptable isotonic agent.

The pharmaceutical compositions of the present invention may comprise one or more pharmaceutically acceptable antioxidants. Exemplary pharmaceutically acceptable antioxidants include water soluble antioxidants, such as, e.g., ascorbic acid, cysteine hydrochloride, methionine, sodium bisulfate, sodium metabisulfite, sodium sulfite and the like; oil-soluble antioxidants, such as, e.g., ascorbyl palmitate, butylated hydroxyanisole (BHA), butylated hydroxytoluene (BHT), lecithin, propylgallate, alpha-tocopherol, and the like; and metal-chelating agents, such as, e.g., citric acid, ethylenediamine tetraacetic acid (EDTA), sorbitol, tartaric acid, phosphoric acid, and the like. In certain embodiments, the pharmaceutical composition of the present invention comprises an aqueous carrier and a pharmaceutically acceptable antioxidant. In certain other embodiments, the pharmaceutical composition of the present invention comprises a salt and/or powder, such as, e.g. a freeze-dried, lyophilized, dehydrated, and/or cryodesiccated composition comprising a pharmaceutically acceptable antioxidant.

A pharmaceutical composition of the present invention may comprise one or more pharmaceutically acceptable surfactants and/or emulsifying agents (emulsifiers). Non-limiting examples of suitable surfactants and/or emulsifiers include polysorbates such as, e.g., polyoxyethylene (20) sorbitan monolaurate (polysorbate 20), polyoxyethylene (20) sorbitan monopalmitate (polysorbate 40), polyoxyethylene (20) sorbitan monostearate (polysorbate 60), and (polyoxyethylene (20) sorbitan monooleate (polysorbate 80). In certain embodiments, the pharmaceutical composition of the present invention comprises an aqueous carrier and a pharmaceutically acceptable surfactant and/or emulsifier. In certain other embodiments, the pharmaceutical composition of the present invention comprises a salt and/or powder, such as, e.g. a freeze-dried, lyophilized, dehydrated, and/or cryodesiccated composition comprising a pharmaceutically acceptable surfactant and/or emulsifier. One or more surfactants and/or emulsifying agents may also be desirable in a pharmaceutical composition of the present invention to help prevent aggregation of the cell-targeting molecule of the present invention. The pharmaceutical compositions of the present invention may comprise one or more pharmaceutically acceptable preservative agents. For example, preventing the presence of microorganisms may be ensured both by sterilization procedures, and by the inclusion of various antibacterial and antifungal agents, such as, e.g., paraben, chlorobutanol, phenol sorbic acid, and the like in the compositions of the present invention.

A pharmaceutical composition of the present invention may comprise one or more pharmaceutically acceptable cryoprotective agents, also referred to as cryoprotectants or cryogenic protectants. Non-limiting examples of suitable cryoprotectants include ethylene glycol, glycerol, sorbitol, sucrose, and trehalose. In certain embodiments, the pharmaceutical composition of the present invention comprises an aqueous carrier and a pharmaceutically acceptable cryoprotectant. In certain other embodiments, the pharmaceutical composition of the present invention comprises a salt and/or powder, such as, e.g. a freeze-dried, lyophilized, dehydrated, and/or cryodesiccated composition comprising a pharmaceutically acceptable cryoprotectant.

In addition, prolonged absorption of the injectable pharmaceutical form may be brought about by the inclusion of agents which delay absorption such as, e.g., a monostearate salt, aluminum monostearate, and/or gelatin.

In another aspect, the present invention provides pharmaceutical compositions comprising one or a combination of different polypeptides and/or cell-targeting molecules of the invention, or an ester, salt or amide of any of the foregoing, and at least one pharmaceutically acceptable carrier.

The pH of the pharmaceutical composition of the present invention can be adjusted with acids or bases, such as hydrochloric acid or sodium hydroxide, or buffers with acetate, citrate, citric acid, histidine, sodium citrate, succinate, phosphate, and the like. Non-limiting examples of pharmaceutically acceptable solvents or carriers for use in a pharmaceutical composition of the present invention include aqueous solutions comprising a cell-targeting molecule of the present invention and a buffer such as, e.g., citrate, histidine, phosphate, or succinate adjusted to pH 5.0, 6.0, 7.0, or 4.0, respectively. Certain embodiments of the present invention include compositions comprising one of the aforementioned solvents and/or carriers of the present invention.

Pharmaceutical compositions of the present invention that are solutions or suspensions used for intradermal or subcutaneous application typically include one or more of: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid, cysteine hydrochloride, methionine, sodium bisulfate, sodium metabisulfite, and sodium sulfite; chelating agents such as citric acid, ethylenediaminetetraacetic acid, sorbitol, tartaric acid, and phosphoric acid; surfactants such as a polysorbate; buffers such as acetate, citrate, histidine, and phosphate buffers; and tonicity adjusting agents such as, e.g., dextrose, glycerol, mannitol, sodium chloride, sorbitol, sucrose, and trehalose. Such preparations may be enclosed in ampoules, disposable syringes or multiple dose vials made of a glass or plastic.

Sterile injectable solutions may be prepared by incorporating a protein or cell-targeting molecule of the present invention in the required amount in an appropriate solvent with one or a combination of ingredients described above, as required, followed by sterilization microfiltration. Dispersions may be prepared by incorporating the active compound into a sterile vehicle that contains a dispersion medium and other ingredients, such as those described above. In the case of sterile powders for the preparation of sterile injectable solutions, the methods of preparation are vacuum drying and freeze-drying (lyophilization) that yield a powder of the active ingredient in addition to any additional desired ingredient from a sterile-filtered solution thereof. In certain embodiments, the pharmaceutical composition of the present invention comprises a powder comprising sorbitol, trehalose, sodium citrate, and polysorbate-20, and optionally, further comprises glycerol and/or methionine. In certain embodiments, the pharmaceutical composition of the present invention comprises sodium citrate, trehalose, and polysorbate-20, and optionally, further comprises glycerol and/or methionine.

In certain embodiments, the pharmaceutical composition of the present invention comprises sorbitol, sodium citrate, and polysorbate-20, and optionally, further comprises albumin, glycerol, and/or methionine. In certain embodiments, the pharmaceutical composition of the present invention comprises sorbitol, histidine, and polysorbate-20, and optionally, further comprises albumin, glycerol, and/or methionine.

The formulations of the pharmaceutical compositions of the present invention may conveniently be presented in unit dosage form and may be prepared by any of the methods well known in the art of pharmacy. In such form, the composition is divided into unit doses containing appropriate quantities of the active component. The unit dosage form can be a packaged preparation, the package containing discrete quantities of the preparations, for example, packeted tablets, capsules, and powders in vials or ampoules. The unit dosage form can also be a capsule, cachet, or tablet itself, or it can be the appropriate number of any of these packaged forms. It may be provided in single dose injectable form, for example in the form of a pen. Compositions may be formulated for any suitable route and means of administration. Subcutaneous or transdermal modes of administration may be particularly suitable for pharmaceutical compositions and therapeutic molecules described herein.

Therapeutic compositions are typically sterile and stable under the conditions of manufacture and storage. The composition may be formulated as a solution, microemulsion, liposome, or other ordered structure suitable to high drug concentration. The carrier may be a solvent or dispersion medium containing, for example, water, alcohol such as ethanol, polyol (e.g. glycerol, propylene glycol, and liquid polyethylene glycol), or any suitable mixtures. The proper fluidity may be maintained, for example, by the use of a coating such as lecithin, by the maintenance of the required particle size in the case of dispersion and by use of surfactants according to formulation chemistry well known in the art. In certain embodiments, isotonic agents, e.g. sugars, polyalcohols such as mannitol, sorbitol, or sodium chloride may be desirable in the composition. Prolonged absorption of injectable compositions may be brought about by including in the composition an agent that delays absorption for example, monostearate salts and gelatin.

Solutions or suspensions used for intradermal or subcutaneous application typically include one or more of: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates; and tonicity adjusting agents such as, e.g., sodium chloride or dextrose. The pH can be adjusted with acids or bases, such as hydrochloric acid or sodium hydroxide, or buffers with citrate, phosphate, acetate and the like. Such preparations may be enclosed in ampoules, disposable syringes or multiple dose vials made of glass or plastic.

Sterile injectable solutions may be prepared by incorporating a cell-targeting molecule of the present invention in the required amount in an appropriate solvent with one or a combination of ingredients described above, as required, followed by sterilization microfiltration. Dispersions may be prepared by incorporating the active compound into a sterile vehicle that contains a dispersion medium and other ingredients, such as those described above. In the case of sterile powders for the preparation of sterile injectable solutions, the methods of preparation are vacuum drying and freeze-drying (lyophilization) that yield a powder of the active ingredient in addition to any additional desired ingredient from a sterile-filtered solution thereof.

When a therapeutically effective amount of a cell-targeting molecule of the present invention is designed to be administered by, e.g. intravenous, cutaneous or subcutaneous injection, the binding agent will be in the form of a pyrogen-free, parenterally acceptable aqueous solution. Methods for preparing parenterally acceptable protein solutions, taking into consideration appropriate pH, isotonicity, stability, and the like, are within the skill in the art. A preferred pharmaceutical composition for intravenous, cutaneous, or subcutaneous injection will contain, in addition to binding agents, an isotonic vehicle such as sodium chloride injection, Ringer's injection, dextrose injection, dextrose and sodium chloride injection, lactated Ringer's injection, or other vehicle as known in the art. A pharmaceutical composition of the present invention may also contain stabilizers, preservatives, buffers, antioxidants, or other additives well known to those of skill in the art.

As described elsewhere herein, a cell-targeting molecule of the present invention or composition thereof (e.g. pharmaceutical or diagnostic composition) may be prepared with carriers that will protect the cell-targeting molecule of the invention against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art (see e.g. *Sustained and Controlled Release Drug Delivery Systems* (Robinson J, ed., Marcel Dekker, Inc., NY, U.S., 1978).

In certain embodiments, the composition of the present invention (e.g. pharmaceutical or diagnostic compositions) may be formulated to ensure a desired distribution in vivo. For example, the blood-brain barrier excludes many large and/or hydrophilic compounds. To target a therapeutic molecule or composition of the present invention to a particular in vivo location, it can be formulated, for example, in liposomes which may comprise one or more moieties that are selectively transported into specific cells or organs, thus enhancing targeted drug delivery. Exemplary targeting moieties include folate or biotin; mannosides; antibodies; surfactant protein A receptor; p120 catenin and the like.

Pharmaceutical compositions include parenteral formulations designed to be used as implants or particulate systems. Examples of implants are depot formulations composed of polymeric or hydrophobic components such as emulsions, ion exchange resins, and soluble salt solutions. Examples of particulate systems are microspheres, microparticles, nanocapsules, nanospheres, and nanoparticles. Controlled release formulations may be prepared using polymers sensitive to ions, such as, e.g. liposomes, polaxamer 407, and hydroxyapatite.

Pharmaceutical compositions of the present invention may be produced using techniques known in the art such that the produced compositions comprise emulsions, liposomes, niosomes, polymeric nanoparticles, and/or solid lipid nanoparticles (SLNs) (see e.g. Lakshmi P et al., *Venereal Leprol* 73: 157-161 (2007); *A Revolution in Dosage Form Design and Development. Recent Advances in Novel Drug Carrier Systems* (Sezer A, ed., InTech, 2012)).

Diagnostic compositions of the present invention comprise a cell-targeting molecule of the invention and one or more detection promoting agents. Various detection promoting agents are known in the art, such as isotopes, dyes, colorimetric agents, contrast enhancing agents, fluorescent agents, bioluminescent agents, and magnetic agents. These agents may be incorporated into the cell-targeting molecule of the invention at any suitable position so long as requisite a functional activity(s) is retained. For example, the linkage or incorporation of the detection promoting agent may be via an amino acid residue(s) of the cell-targeting molecule of the present invention or via some type of linkage known in the art, including via linkers and/or chelators. The association of the detection promoting agent with a cell-targeting molecule of a diagnostic composition of the present invention is in such a way to enable the detection of the presence of the cell-targeting molecule and/or its target cell after internalization of the cell-targeting molecule in a screen, assay, diagnostic procedure, and/or imaging technique.

There are numerous detection promoting agents known to the skilled worker which can be operably associated or linked to the cell-targeting molecule of the present invention for information gathering methods, such as for diagnostic and/or prognostic applications to diseases, disorders, or conditions of an organism. For example, detection promoting agents include image enhancing contrast agents, such as fluorescent dyes (e.g. Alexa680, indocyanine green, and Cy5.5), isotopes and radionuclides, such as $^{11}C$, $^{13}N$, $^{15}O$, $^{18}F$, $^{32}P$, $^{51}Mn$, $^{52}mMn$, $^{12}Fe$, $^{55}Co$, $^{62}Cu$, $^{64}Cu$, $^{67}Cu$, $^{67}Ga$, $^{68}Ga$, $^{72}As$, $^{73}Se$, $^{75}Br$, $^{76}Br$, $^{82}mRb$, $^{83}Sr$, $^{86}Y$, $^{90}Y$, $^{89}Zr$, $^{94}mTc$, $^{94}Tc$, $^{99}mTc$, $^{11}In$, $^{111}In$, $^{120}I$, $^{123}I$, $^{124}I$, $^{125}I$, $^{131}I$, $^{154}Gd$, $^{155}Gd$, $^{156}Gd$, $^{157}Gd$, $^{158}Gd$, $^{177}Lu$, $^{186}Re$, $^{18}Re$, and $^{223}R$; paramagnetic ions, such as chromium (III), manganese (II), iron (III), iron (II), cobalt (II), nickel (II), copper (II), neodymium (III), samarium (III), ytterbium (III), gadolinium (III), vanadium (II), terbium (III), dysprosium (II), holmium (III) or erbium (III); metals, such as lanthanum (III), gold (III), lead (II), and bismuth (III); ultrasound-contrast enhancing agents, such as liposomes; radiopaque agents, such as barium, gallium, and thallium compounds. Detection promoting agents may be incorporated directly or indirectly by using an intermediary functional group, such as chelators like 2-benzyl DTPA, PAMAM, NOTA, DOTA, TETA, analogs thereof, and functional equivalents of any of the foregoing.

There are numerous imaging approaches in the art which are known to the skilled worker, such as non-invasive in vivo imaging techniques commonly used in the medical arena, for example: computed tomography imaging (CT scanning), optical imaging (including direct, fluorescent, and bioluminescent imaging), magnetic resonance imaging (MRI), positron emission tomography (PET), single-photon emission computed tomography (SPECT), ultrasound, and x-ray computed tomography imaging.

The phrase "diagnostically sufficient amount" refers to an amount that provides adequate detection and accurate measurement for information gathering purposes by the particular assay or diagnostic technique utilized. Generally, the diagnostically sufficient amount for whole organism, in vivo, diagnostic use will be a non-cumulative dose of between 0.001 mg to 1 mg of the detection promoting agent linked to cell-targeting molecule per kilogram (kg) of subject per subject (mg/kg). However, the diagnostically sufficient amount for whole organism, in vivo, diagnostic use may be a non-cumulative dose of between 0.0001 mg to 10 mg of the detection promoting agent linked to cell-targeting molecule per kilogram (kg) of subject per subject (mg/kg). Typically, the amount of cell-targeting molecule of the present invention used in these information-gathering methods will be as low as possible provided that it is still a diagnostically sufficient amount. For example, for in vivo detection in an organism, the amount of cell-targeting molecule or diagnostic composition of the present invention administered to a subject will be as low as feasibly possible.

VII. Production or Manufacture of a Pharmaceutical and/or Diagnostic Composition Comprising a Cell-Targeting Molecule of the Present Invention Pharmaceutically acceptable salts or solvates of any of the cell-targeting molecules of the invention are likewise within the scope of the present invention.

The term "solvate" in the context of the present invention refers to a complex of defined stoichiometry formed between a solute (in casu, a cell-targeting molecule or pharmaceutically acceptable salt thereof according to the invention) and a solvent. The solvent in this connection may, for example, be water, ethanol or another pharmaceutically acceptable, typically small-molecular organic species, such as, but not limited to, acetic acid or lactic acid. When the solvent in question is water, such a solvate is normally referred to as a hydrate.

Cell-targeting molecules of the present invention, or salts thereof, may be formulated as pharmaceutical compositions prepared for storage or administration, which typically comprise a therapeutically effective amount of a compound of the present invention, or a salt thereof, in a pharmaceutically acceptable carrier. The term "pharmaceutically acceptable carrier" includes any of the standard pharmaceutical carriers. Pharmaceutically acceptable carriers for therapeutic use are well known in the pharmaceutical art, and are described, for example, in *Remington's Pharmaceutical Sciences* (Mack Publishing Co. (A. Gennaro, ed., 1985)). As used herein, "pharmaceutically acceptable carrier" includes any and all physiologically acceptable, i.e. compatible, solvents, dispersion media, coatings, antimicrobial agents, isotonic, and absorption delaying agents, and the like. Pharmaceutically acceptable carriers or diluents include those used in formulations suitable for oral, rectal, nasal or parenteral (including subcutaneous, intramuscular, intravenous, intradermal, and transdermal) administration. Exemplary pharmaceutically acceptable carriers include sterile aqueous solutions or dispersions and sterile powders for the extemporaneous preparation of sterile injectable solutions or dispersions. Examples of suitable aqueous and nonaqueous carriers that may be employed in the pharmaceutical compositions of the invention include water, ethanol, polyols (such as glycerol, propylene glycol, polyethylene glycol, and the like), and suitable mixtures thereof, vegetable oils, such as olive oil, and injectable organic esters, such as ethyloleate. Proper fluidity can be maintained, for example, by the use of coating materials, such as lecithin, by the maintenance of the required particle size in the case of dispersions, and by the use of surfactants. In certain embodiments, the carrier is suitable for intravenous, intramuscular, subcutaneous, parenteral, spinal or epidermal administration (e.g. by injection or infusion). Depending on selected route of administration, the protein or other pharmaceutical component may be coated in a material intended to protect the compound from the action of low pH and other natural inactivating conditions to which the active protein may encounter when administered to a patient by a particular route of administration.

The formulations of the pharmaceutical compositions of the invention may conveniently be presented in unit dosage form and may be prepared by any of the methods well known in the art of pharmacy. In such form, the composition is divided into unit doses containing appropriate quantities of the active component. The unit dosage form can be a packaged preparation, the package containing discrete quantities of the preparations, for example, packeted tablets, capsules, and powders in vials or ampoules. The unit dosage form can also be a capsule, cachet, or tablet itself, or it can be the appropriate number of any of these packaged forms. It may be provided in single dose injectable form, for example in the form of a pen. Compositions may be formulated for any suitable route and means of administration. Subcutaneous or transdermal modes of administration may be particularly suitable for pharmaceutical compositions and therapeutic molecules described herein.

The pharmaceutical compositions of the present invention may also contain adjuvants such as preservatives, wetting agents, emulsifying agents and dispersing agents. Preventing the presence of microorganisms may be ensured both by sterilization procedures, and by the inclusion of various antibacterial and antifungal agents, for example, paraben, chlorobutanol, phenol sorbic acid, and the like. Isotonic agents, such as sugars, sodium chloride, and the like into the compositions, may also be desirable. In addition, prolonged absorption of the injectable pharmaceutical form may be brought about by the inclusion of agents which delay absorption such as, aluminum monostearate and gelatin.

A pharmaceutical composition of the present invention also optionally includes a pharmaceutically acceptable antioxidant. Exemplary pharmaceutically acceptable antioxidants are water soluble antioxidants such as ascorbic acid, cysteine hydrochloride, sodium bisulfate, sodium metabisulfite, sodium sulfite and the like; oil-soluble antioxidants, such as ascorbyl palmitate, butylated hydroxyanisole (BHA), butylated hydroxytoluene (BHT), lecithin, propylgallate, alpha-tocopherol, and the like; and metal chelating agents, such as citric acid, ethylenediamine tetraacetic acid (EDTA), sorbitol, tartaric acid, phosphoric acid, and the like.

In another aspect, the present invention provides pharmaceutical compositions comprising one or a combination of different cell-targeting molecules of the invention, or an ester, salt or amide of any of the foregoing, and at least one pharmaceutically acceptable carrier.

Therapeutic compositions are typically sterile and stable under the conditions of manufacture and storage. The composition may be formulated as a solution, microemulsion, liposome, or other ordered structure suitable to high drug concentration. The carrier may be a solvent or dispersion medium containing, for example, water, alcohol such as ethanol, polyol (e.g. glycerol, propylene glycol, and liquid polyethylene glycol), or any suitable mixtures. The proper fluidity may be maintained, for example, by the use of a coating such as lecithin, by the maintenance of the required particle size in the case of dispersion and by use of surfactants according to formulation chemistry well known in the art. In certain embodiments, isotonic agents, e.g. sugars, polyalcohols such as mannitol, sorbitol, or sodium chloride may be desirable in the composition. Prolonged absorption of injectable compositions may be brought about by including in the composition an agent that delays absorption for example, monostearate salts and gelatin.

Solutions or suspensions used for intradermal or subcutaneous application typically include one or more of: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates; and tonicity adjusting agents such as, e.g., sodium chloride or dextrose. The pH can be adjusted with acids or bases, such as hydrochloric acid or sodium hydroxide, or buffers with citrate, phosphate, acetate and the like. Such preparations may be enclosed in ampoules, disposable syringes or multiple dose vials made of glass or plastic.

Sterile injectable solutions may be prepared by incorporating a cell-targeting molecule of the invention in the required amount in an appropriate solvent with one or a combination of ingredients described above, as required, followed by sterilization microfiltration. Dispersions may be prepared by incorporating the active compound into a sterile vehicle that contains a dispersion medium and other ingredients, such as those described above. In the case of sterile powders for the preparation of sterile injectable solutions, the methods of preparation are vacuum drying and freeze-drying (lyophilization) that yield a powder of the active ingredient in addition to any additional desired ingredient from a sterile-filtered solution thereof.

When a therapeutically effective amount of a cell-targeting molecule of the invention is designed to be administered by, e.g. intravenous, cutaneous or subcutaneous injection, the binding agent will be in the form of a pyrogen-free, parenterally acceptable aqueous solution. Methods for preparing parenterally acceptable protein solutions, taking into consideration appropriate pH, isotonicity, stability, and the like, are within the skill in the art. A preferred pharmaceutical composition for intravenous, cutaneous, or subcutaneous injection will contain, in addition to binding agents, an isotonic vehicle such as sodium chloride injection, Ringer's injection, dextrose injection, dextrose and sodium chloride injection, lactated Ringer's injection, or another vehicle as known in the art. A pharmaceutical composition of the present invention may also contain stabilizers, preservatives, buffers, antioxidants, or other additives well known to those of skill in the art.

As described elsewhere herein, a cell-targeting molecule, or composition of the present invention (e.g. pharmaceutical or diagnostic composition) may be prepared with carriers that will protect the cell-targeting molecule against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art (see e.g. *Sustained and Controlled Release Drug Delivery Systems* (Robinson J, ed., Marcel Dekker, Inc., NY, U.S., 1978)).

In certain embodiments, the composition of the present invention (e.g. pharmaceutical or diagnostic composition) may be formulated to ensure a desired distribution in vivo. For example, the blood-brain barrier excludes many large and/or hydrophilic compounds. To target a therapeutic cell-targeting molecule or composition of the invention to a particular in vivo location, it can be formulated, for example, in liposomes which may comprise one or more moieties that are selectively transported into specific cells or organs, thus enhancing targeted drug delivery. Exemplary targeting moieties include folate or biotin; mannosides; antibodies; surfactant protein A receptor; p120 catenin and the like.

Pharmaceutical compositions include parenteral formulations designed to be used as implants or particulate systems. Examples of implants are depot formulations composed of polymeric or hydrophobic components such as emulsions, ion exchange resins, and soluble salt solutions. Examples of particulate systems are microspheres, microparticles, nanocapsules, nanospheres, and nanoparticles (see e.g. Honda M et al., *Int J Nanomedicine* 8: 495-503 (2013); Sharma A et al., *Biomed Res Int* 2013: 960821 (2013); Ramishetti S, Huang L, *Ther Deliv* 3: 1429-45 (2012)). Controlled release formulations may be prepared using polymers sensitive to ions, such as, e.g. liposomes, polaxamer 407, and hydroxyapatite.

VIII. Polynucleotides, Expression Vectors, and Host Cells of the Invention

Beyond the cell-targeting molecules of the present invention and their polypeptide components, the polynucleotides that encode the polypeptides and cell-targeting molecules of the invention, or functional portions thereof, are also encompassed within the scope of the present invention. The term "polynucleotide" is equivalent to the term "nucleic acid," each of which includes one or more of: polymers of deoxyribonucleic acids (DNAs), polymers of ribonucleic acids (RNAs), analogs of these DNAs or RNAs generated using nucleotide analogs, and derivatives, fragments and homologs thereof. The polynucleotide of the present invention may be single-, double-, or triple-stranded. Such polynucleotides are specifically disclosed to include all polynucleotides capable of encoding an exemplary protein, for example, taking into account the wobble known to be tolerated in the third position of RNA codons, yet encoding for the same amino acid as a different RNA codon (see Stothard P, *Biotechniques* 28: 1102-4 (2000)).

In one aspect, the invention provides polynucleotides which encode a cell-targeting molecule of the invention (e.g. a fusion protein), or a polypeptide fragment or derivative thereof. The polynucleotides may include, e.g., nucleic acid sequence encoding a polypeptide of at least 50%, 55%, 60%, 65%, 70%, 75%, 80%, 85%, 90%, 95%, 99% or more, identity to a polypeptide comprising one of the amino acid sequences of the protein. The invention also includes polynucleotides comprising nucleotide sequences that hybridize under stringent conditions to a polynucleotide which encodes a cell-targeting molecule of the invention, or a polypeptide fragment or derivative thereof, or the antisense or complement of any such sequence.

Derivatives or analogs of the cell-targeting molecules of the present invention include, inter alia, polynucleotide (or polypeptide) molecules having regions that are substantially homologous to the polynucleotides, cell-targeting molecules, or polypeptide components of the cell-targeting molecules of the present invention, e.g. by at least about 45%, 50%, 70%, 80%, 95%, 98%, or even 99% identity (with a preferred identity of 80-99%) over a polynucleotide or polypeptide sequence of the same size or when compared to an aligned sequence in which the alignment is done by a computer homology program known in the art. An exemplary program is the GAP program (Wisconsin Sequence Analysis Package, Version 8 for UNIX, Genetics Computer Group, University Research Park, Madison, Wis., U.S.) using the default settings, which uses the algorithm of Smith T, Waterman M, *Adv Appl Math* 2: 482-9 (1981). Also included are polynucleotides capable of hybridizing to the complement of a sequence encoding the cell-targeting molecule of the invention under stringent conditions (see e.g. Ausubel F et al., *Current Protocols in Molecular Biology* (John Wiley & Sons, New York, N.Y., U.S., 1993)), and below. Stringent conditions are known to those skilled in the art and may be found, e.g., in *Current Protocols in Molecular Biology* (John Wiley & Sons, NY, U.S., Ch. Sec. 6.3.1-6.3.6 (1989)).

The present invention further provides expression vectors that comprise the polynucleotides within the scope of the present invention. The polynucleotides capable of encoding the cell-targeting molecules of the invention, or polypeptide components thereof, may be inserted into known vectors, including bacterial plasmids, viral vectors and phage vectors, using material and methods well known in the art to produce expression vectors. Such expression vectors will include the polynucleotides necessary to support production of contemplated cell-targeting molecules of the invention within any host cell of choice or cell-free expression systems (e.g. pTxb1 and pIVEX2.3). The specific polynucleotides comprising expression vectors for use with specific types of host cells or cell-free expression systems are well known to one of ordinary skill in the art, can be determined using routine experimentation, or may be purchased.

The term "expression vector," as used herein, refers to a polynucleotide, linear or circular, comprising one or more expression units. The term "expression unit" denotes a polynucleotide segment encoding a polypeptide of interest and capable of providing expression of the nucleic acid segment in a host cell. An expression unit typically comprises a transcription promoter, an open reading frame encoding the polypeptide of interest, and a transcription terminator, all in operable configuration. An expression vector contains one or more expression units. Thus, in the context of the present invention, an expression vector encoding a cell-targeting molecule of the invention (e.g. a scFv genetically recombined with a Shiga toxin effector polypeptide fused to a T-cell epitope-peptide) includes at least an expression unit for the single polypeptide chain, whereas a protein comprising, e.g. two or more polypeptide chains (e.g. one chain comprising a $V_L$ domain and a second chain comprising a $V_H$ domain linked to a toxin effector region) includes at least two expression units, one for each of the two polypeptide chains of the protein. For expression of multi-chain cell-targeting proteins of the invention, an expression unit for each polypeptide chain may also be separately contained on different expression vectors (e.g. expression may be achieved with a single host cell into which expression vectors for each polypeptide chain has been introduced).

Expression vectors capable of directing transient or stable expression of polypeptides and proteins are well known in the art. The expression vectors generally include, but are not limited to, one or more of the following: a heterologous signal sequence or peptide, an origin of replication, one or more marker genes, an enhancer element, a promoter, and a transcription termination sequence, each of which is well known in the art. Optional regulatory control sequences, integration sequences, and useful markers that can be employed are known in the art.

Cell-free systems can be used to produce cell-targeting molecules of the present invention (see e.g. Jaing X et al., *FEBS Lett* 514: 290-4 (2002); Kawasaki T et al., *Eur J Biochem* 270: 4780-6 (2003); Ali M et al., *J Biosci Bioeng* 99: 181-6 (2005); Galeffi P et al., *J Transl Med* 4: 39 (2006); Han Y et al., *Biotechnol Prog* 22: 1084-9 (2006); Schenk J et al., *Biochimie* 89: 1304-11 (2007); Oh I et al., *Bioproc*

*Biosyst Eng* 33 127-32 (2010); Merk H et al., *BioTechniques* 53: 153-60 (2012); Stech M et al., *J Biotechnol* 164: 220-31 (2012); Yin G et al., *mAbs* 4: 217-25 (2012); Groff D et al., *mAbs* 6: 671-8 (2014); Stech M et al., *Eng Life Sci* 14: 387-98 (2014); Stech M, Kubick S, *Antibodies* 4: 12-33 (2015); Thoring L et al., *Sci Rep* 7: 11710 (2017); Stech M et al., *Sci Rep* 7: 12030 (2017)).

The term "host cell" refers to a cell which can support the replication or expression of the expression vector. Host cells may be prokaryotic cells, such as *E. coli* or eukaryotic cells (e.g. yeast, insect, amphibian, bird, or mammalian cells). Creation and isolation of host cell lines comprising a polynucleotide of the invention or capable of producing a cell-targeting molecule of the invention, or polypeptide component thereof, can be accomplished using standard techniques known in the art.

Cell-targeting molecules within the scope of the present invention may be variants or derivatives of the polypeptides and proteins described herein that are produced by modifying the polynucleotide encoding a polypeptide and/or protein by altering one or more amino acids or deleting or inserting one or more amino acids that may render it more suitable to achieve desired properties, such as more optimal expression by a host cell.

IX. Delivery Devices and Kits

In certain embodiments, the invention relates to a device comprising one or more compositions of matter of the invention, such as a pharmaceutical composition, for delivery to a subject in need thereof. Thus, a delivery device comprising one or more compounds of the invention may be used to administer to a patient a composition of matter of the invention by various delivery methods, including: intravenous, subcutaneous, intramuscular or intraperitoneal injection; oral administration; transdermal administration; pulmonary or transmucosal administration; administration by implant, osmotic pump, cartridge or micro pump; or by other means recognized by a person of skill in the art.

Also within the scope of the present invention are kits comprising at least one composition of matter of the invention, and optionally, packaging and instructions for use. Kits may be useful for drug administration and/or diagnostic information gathering. A kit of the invention may optionally comprise at least one additional reagent (e.g., standards, markers and the like). Kits typically include a label indicating the intended use of the contents of the kit. The kit may further comprise reagents and other tools for detecting a cell-type (e.g. a tumor cell) in a sample or in a subject, or for diagnosing whether a patient belongs to a group that responds to a therapeutic strategy which makes use of a cell-targeting molecule of the present invention, or composition thereof, or related method of the present invention as described herein.

X. Methods for Using a Cell-Targeting Molecule of the Present Invention and Pharmaceutical Composition and/or Diagnostic Composition Thereof Generally, it is an object of the present invention to provide pharmacologically active agents, as well as compositions comprising the same, that can be used in the prevention and/or treatment of diseases, disorders, and conditions, such as certain cancers, tumors, growth abnormalities, immune disorders, or further pathological conditions mentioned herein. Accordingly, the present invention provides methods of using the cell-targeting molecules, pharmaceutical compositions, and diagnostic compositions of the present invention for the delivery of a CD8+ T-cell epitope-peptide cargo to the MC class I presentation pathways of target cells, targeted killing of specific cells, labeling of the cell-surfaces of target cells with specific pMHC Is and/or specific interior compartments of target cells, for collecting diagnostic information, and for treating diseases, disorders, and conditions as described herein. For example, the methods of the present invention may be used as an immunotherapy to prevent or treat cancers, cancer initiation, tumor initiation, metastasis, and/or cancer disease reoccurrence.

In particular, it is an object of the present invention to provide such pharmacologically active agents, compositions, and/or methods that have certain advantages compared to the agents, compositions, and/or methods that are currently known in the art. Accordingly, the present invention provides methods of using cell-targeting molecules characterized by specified protein sequences and pharmaceutical compositions thereof. For example, any of the polypeptide sequences in SEQ ID NOs: 4-255, 259-278, and 288-748 may be specifically utilized as a component of the cell-targeting molecules used in the following methods or any method for using a cell-targeting molecule known to the skilled worker, such as, e.g., various methods described in WO 2014/164680, WO 2014/164693, WO 2015/138435, WO 2015/138452, WO 2015/113005, WO 2015/113007, WO 2015/191764, US2015/259428, US2014/965882, WO 2016/196344, WO 2017/019623, and PCT/US2017/065074.

The present invention provides methods of delivering a CD8+ T-cell epitope-peptide cargo to a cell, the method comprising the step of contacting the cell, either in vitro or in vivo, with a cell-targeting molecule or pharmaceutical composition of the present invention. In certain further embodiments, the cell-targeting molecule of the present invention causes, after the contacting step, an intercellular engagement of the cell by an immune cell, such as, e.g., a CD8+ T-cell and/or CTL, either in vitro cell culture or in vivo within a living chordate. The presentation of a CD8+ T-cell epitope by a target cell within an organism can lead to the activation of robust immune responses to a target cell and/or its general locale within an organism. Thus, the targeted delivery of a CD8+ T-cell epitope cargo for presentation may be utilized for as a mechanism for activating CD8+ T-cell responses during a therapeutic regime and/or vaccination strategy.

The present invention provides methods of delivering to a MHC class I presentation pathway of a chordate cell a CD8+ T-cell epitope-peptide, the method comprising the step of contacting the cell, either in vitro or in vivo, with a cell-targeting molecule, pharmaceutical composition, and/or diagnostic composition of the present invention. In certain further embodiments, the cell-targeting molecule of the present invention causes, after the contacting step, an intercellular engagement of the cell by an immune cell, such as, e.g., a CD8+ T-cell and/or CTL, either in vitro cell culture or in vivo within a chordate.

The delivery of the CD8+ T-cell epitope-peptide cargo to the MHC class I presentation pathway of a target cell using a cell-targeting molecule of the invention can be used to induce the target cell to present the epitope-peptide in association with MHC class I molecules on a cell surface. In a chordate, the presentation of an immunogenic, CD8+ T-cell epitope by the MHC class I complex can sensitize the presenting cell for killing by CTL-mediated cytolysis, induce immune cells into altering the microenvironment, and signal for the recruitment of more immune cells to the target cell site within the chordate. Thus, the cell-targeting molecules of the present invention, and compositions thereof, can be used to kill a specific cell-type upon contacting a cell or cells with a cell-targeting molecule of the present invention and/or can be used to stimulate an immune response in a chordate.

By engineering MHC class I epitopes, such as, e.g., from a known viral antigen, into cell-targeting molecules, the targeted delivery and presentation of immuno-stimulatory antigens may be used to harness and direct beneficial function(s) of a chordate immune cell, e.g. in vitro, and/or a chordate immune system in vivo. This may be accomplished by exogenous administration of the cell-targeting molecule into an extracellular space, such as, e.g., the lumen of a blood vessel, and then allowing for the cell-targeting molecule to find a target cell, enter the cell, and intracellularly deliver its CD8+ T-cell epitope cargo. The applications of these CD8+ T-cell epitope cargo delivery and MHC class I presenting functions of the cell-targeting molecules of the present invention are vast. For example, the delivery of a CD8+ epitope cargo to a cell and the MHC class I presentation of the delivered epitope by the cell in a chordate can cause the intercellular engagement of a CD8+ effector T-cell and may lead to a CTL(s) killing the target cell and/or secreting immuno-stimulatory cytokines.

Certain embodiments of the present invention is an immunotherapeutic method, the method comprising the step of administering to a patient, in need thereof, a cell-targeting molecule and/or pharmaceutical composition of the present invention. In certain further embodiments, the immunotherapeutic method is a method of treating a disease, disorder, and/or condition (such as, e.g., a cancer, tumor, growth abnormality, immune disorder, and/or microbial infection), by stimulating a beneficial immune response in the patient.

Certain embodiments of the present invention is an immunotherapeutic method of treating cancer, the method comprising the step of administering to a patient, in need thereof, a cell-targeting molecule and/or pharmaceutical composition of the present invention. In certain further embodiments, the method comprises the additional steps of administering to the patient an adjuvant and/or microbiome-altering agent (see e.g. Vetizou M et al., *Science* 350: 1079-84 (2015); Ayelet S et al., *Science* 350: 1084-9 (2015); US2015/352206; WO2016/063263).

The present invention provides immunotherapy methods involving delivering a CD8+ T-cell epitope-peptide cargo to a target cell in a chordate and causing an immune response, the method comprising the step of administering to the chordate a cell-targeting molecule or pharmaceutical composition of the present invention. For certain further embodiments, the immune response is an intercellular immune cell response selected from the group consisting of: CD8+ immune cell secretion of a cytokine(s), CTL induced growth arrest in the target cell, CTL induced necrosis of the target cell, CTL, induced apoptosis of the target cell, non-specific cell death in a tissue locus, intermolecular epitope spreading, breaking immunological tolerance to a malignant cell type, and the chordate acquiring persistent immunity to a malignant cell-type (see e.g. Matsushita H et al., *Cancer Immunol Res* 3: 26-36 (2015)). These immune responses can be detected and/or quantified using techniques known to the skilled worker. For example, CD8+ immune cells can release immuno-stimulatory cytokines, such as, e.g., IFN-γ, tumor necrosis factor alpha (TNFα), macrophage inflammatory protein-1 beta (MIP-1β), and interleukins such as IL-17, IL-4, IL-22, and IL-2 (see e.g. Examples, infra; Seder R et al., *Nat Rev Immunol* 8: 247-58 (2008)). IFN-γ can increase MHC class I molecule expression and sensitize neoplastic cells to CTL-mediated cell killing (Vlková V et al., *Oncotarget* 5: 6923-35 (2014)). Inflammatory cytokines can stimulate bystander T-cells that harbor unrelated TCR specificities to the cytokine releasing cell (see e.g. Tough D et al., *Science* 272: 1947-50 (1996)). Activated CTLs can indiscriminately kill cells proximal to epitope-MHC class I complex presenting cell regardless of the proximal cell's present peptide-MHC class I complex repertoire (Wiedemann A et al., *Proc Natl Acad Sci USA* 103: 10985-90 (2006)). Thus, for certain further embodiments, the immune response is an intercellular immune cell response selected from the group consisting of: proximal cell killing mediated by immune cells where the proximal cell is not displaying any CD8+ T-cell epitope-peptide delivered by the cell-targeting molecule of the present invention and regardless of the presence of any extracellular target biomolecule of the binding region of the cell-targeting molecule physically coupled to the proximal cell(s) that is killed.

The presence of non-self epitopes in CTL-lysed cells, whether target cells or cells merely proximal to target cells, can be recognized and targeted as foreign by the immune system, including recognition of non-self epitopes in target cells via the mechanism of intermolecular epitope spreading (see McCluskey J et al., *Immunol Rev* 164: 209-29 (1998); Vanderlugt C et al., *Immunol Rev* 164: 63-72 (1998); Vanderlugt C, Miller S, *Nat Rev Immunol* 2: 85-95 (2002)). Proximal cells may include non-neoplastic cells, such as, e.g., cancer associated fibroblasts, mesenchymal stem cells, tumor-associated endothelial cells, and immature myeloid-derived suppressor cells. For example, a cancer cell may harbor on average 25 to 500 nonsynonymous mutations in coding sequences (see e.g. Fritsch E et al., *Cancer Immunol Res* 2: 522-9 (2014)). Both cancer driver and non-driver mutations are part of the mutational landscape of a cancer cell that corresponds to numerous non-self epitopes per cell and the average tumor may possess ten or more non-self epitopes (see e.g. Segal N et al., *Cancer Res* 68: 889-92 (2008)). For example, mutant forms of the tumor protein p53 can contain non-self epitopes (see e.g. Vigneron N et al., *Cancer Immun* 13: 15 (2013)). In addition, the presence of non-self epitopes, such as mutated self-proteins, can result in the production of memory cells specific to those new epitope(s). Because certain embodiments of the cell-targeting molecules of the present invention may increase dendritic cell sampling at a targeted tissue locus, the probability of cross-priming the immune system with intracellular antigens may be increased (see e.g. Chiang C et al., *Expert Opin Biol Ther* 15: 569-82 (2015)). Thus, as a result of cell-targeting molecule delivery of a heterologous, CD8+ T-cell epitope cargo and MHC class I presentation of that epitope, target cells and other proximal cells containing non-self epitopes can be rejected by the immune system, including via non-self epitopes other than epitopes delivered by a cell-targeting molecule of the invention. Such mechanisms could, e.g., induce antitumor immunity against tumor cells which do not express the extracellular target biomolecule of the binding region of the cell-targeting molecule.

Immune responses which involve cytokine secretion and/or T-cell activation may result in modulation of the immuno-microenvironment of a locus within a chordate. A method of the present invention may be used to alter the microenvironment of a tissue locus within a chordate in order to change the regulatory homeostasis on immune cells, such as, e.g. tumor-associated macrophages, T-cells, T helper cells, antigen presenting cells, and natural killer cells.

For certain embodiments, a method of the present invention may be used to enhance anti-tumor cell immunity in a chordate subject and/or to create a persistent anti-tumor immunity in a chordate, such as, e.g., due to the development of memory T-cells and/or alterations to the tumor microenvironment.

Certain embodiments of the cell-targeting molecules of the present invention, or pharmaceutical compositions thereof, can be used to "seed" a locus within a chordate with non-self, CD8+ T-cell epitope-peptide presenting cells in order to stimulate the immune system to police the locus with greater strength and/or to alleviate immuno-inhibitory signals, e.g., anergy inducing signals. In certain further embodiments of this "seeding" method of the present invention, the locus is a tumor mass or infected tissue site. In certain embodiments of this "seeding" method of the present invention, the non-self, CD8+ T-cell epitope-peptide is selected from the group consisting of: peptides not already presented by the target cells of the cell-targeting molecule, peptides not present within any protein expressed by the target cell, peptides not present within the proteome or transcriptome of the target cell, peptides not present in the extracellular microenvironment of the site to be seeded, and peptides not present in the tumor mass or infect tissue site to be targeting.

This "seeding" method functions to label one or more target cells within a chordate with one or more MHC class I presented CD8+ T-cell epitopes (pMHC Is) for intercellular recognition by immune cells and activation of downstream immune responses. By exploiting the cell-internalizing, intracellularly routing, and/or MHC class I epitope delivering functions of the cell-targeting molecules of the present invention, the target cells that display the delivered CD8+ T-cell epitope can be recognized by immunosurveillance mechanisms of the chordate's immune cells and result in intercellular engagement of the presenting target cell by CD8+ T-cells, such as, e.g., CTLs. This "seeding" method of using a cell-targeting molecule of the present invention may stimulate immune cell mediated killing of target cells regardless of whether they are presenting a cell-targeting molecule-delivered T-cell epitope(s), such as, e.g., as a result of intermolecular epitope spreading and/or breaking of immuno-tolerance to the target cell based on presentation of endogenous antigens as opposed to artificially delivered epitopes. This "seeding" method of using a cell-targeting molecule of the present invention may provide a vaccination effect (new epitope(s) exposure) and/or vaccination-booster-dose effect (epitope re-exposure) by inducing adaptive immune responses to cells within the seeded microenvironment, such as, e.g. a tumor mass or infected tissue site, based on the detection of epitopes which are either recognized as foreign by naïve T-cells and/or already recognizable as non-self (i.e. recall antigens) by memory T-cells. This "seeding" method may also induce the breaking of immuno-tolerance to a target cell population, a tumor mass, diseased tissue site, and/or infected tissue site within a chordate, either peripherally or systemically.

The presence of dying or necrotic tumor cells at site or loci within a chordate may result in a localized immune stimulation effect. For example, dying or necrotic tumor cells can release factors, such as, e.g., high mobility group proteins and/or ATP, which in turn can stimulate immunogenic maturation of immune cells. The seeding of a tumor locus may also induce or increase the ectopic expression of ER proteins (e.g., calreticulin) on the plasma membrane of tumor cells which in turn can promote/increase MHC class antigen presentation and phagocytosis of tumor cells at that site.

Certain methods of the present invention involving the seeding of a locus within a chordate with one or more antigenic and/or immunogenic CD8+ T-cell epitopes may be combined with the administration of immunologic adjuvants, whether administered locally or systemically, to stimulate the immune response to certain antigens, such as, e.g., the co-administration of a composition of the present invention with one or more immunologic adjuvants like a cytokine, bacterial product, or plant saponin. Other examples of immunologic adjuvants which may be suitable for use in the methods of the present invention include aluminum salts and oils, such as, e.g., alums, aluminum hydroxide, mineral oils, squalene, paraffin oils, peanut oils, and thimerosal.

Certain methods of the present invention involve promoting immunogenic cross-presentation and/or cross-priming of naïve CD8+ T-cells in a chordate. For certain methods of the present invention, cross-priming occurs as a result of the death, and/or the manner of death, of a target cell caused by a cell-targeting molecule of the present invention such that the exposure of intracellular antigens in the dying or dead target cell to immunosurveillance mechanisms is promoted.

Because multiple, heterologous, CD8+ T-cell epitopes (either as cargos or as embedded or inserted regions of a Shiga toxin effector polypeptide component) may be delivered by a single cell-targeting molecule of the present invention, a single embodiment of the cell-targeting molecule of the present invention may be therapeutically effective in different individual chordates of the same species with different MHC I class molecule variants, such as, e.g., in humans with different HLA alleles. This ability of certain embodiments of the present invention may allow for the combining within a single cell-targeting molecule of different CD8+ T-cell epitope-peptides with different therapeutic effectiveness in different sub-populations of subjects based on MHC class I molecule diversity and polymorphisms. For example, human MHC class I molecules, the HLA proteins, vary among humans based on genetic ancestry, e.g. African (sub-Saharan), Amerindian, Caucasiod, Mongoloid, New Guinean and Australian, or Pacific islander.

Cell-targeting molecules of the present invention which can deliver heterologous, CD8+ T-cell epitopes from CMV antigens may be particularly effective because a majority of the human population has specific sets of CD8+ T-cells primed to react to CMV antigens and are constantly repressing chronic CMV infections to remain asymptomatic for their entire life. In addition, elderly humans may reactive even more quickly and strongly to CMV CD8+ T-cell epitopes due to age-related changes in the adaptive immune system regarding CMV, such as, e.g., a potentially more focused immune surveillance toward CMV and as shown by the composition of the T-cell antigen receptor repertoire and relative CTL levels in more elderly humans (see e.g. Koch S et al., *Ann N Y Acad Sci* 1114: 23-35 (2007); Vescovini R et al., *J Immunol* 184: 3242-9 (2010); Cicin-Sain L et al., *J Immunol* 187: 1722-32 (2011); Fülöp T et al., *Front Immunol* 4: 271 (2013); Pawelec G, *Exp Gerontol* 54: 1-5 (2014)).

The present invention provides methods of killing a cell comprising the step of contacting the cell, either in vitro or in vivo, with a cell-targeting molecule or pharmaceutical composition of the present invention. The cell-targeting molecules and pharmaceutical compositions of the present invention can be used to kill a specific cell-type upon contacting a cell or cells with one of the claimed compositions of matter. In certain embodiments, a cell-targeting molecule or pharmaceutical composition of the present invention can be used to kill specific cell-types in a mixture of different cell-types, such as mixtures comprising cancer cells, infected cells, and/or hematological cells. In certain embodiments, a cell-targeting molecule or pharmaceutical composition of the present invention can be used to kill cancer cells in a mixture of different cell-types. In certain embodiments, a cell-targeting molecule or pharmaceutical composition of the present invention can be used to kill specific cell-types in a mixture of different cell-types, such as pre-transplantation tissues. In certain embodiments, a cell-targeting molecule or pharmaceutical composition of the present invention can be used to kill specific cell-types in a mixture of cell-types, such as pre-administration tissue material for therapeutic purposes. In certain embodiments, a cell-targeting molecule or pharmaceutical composition of the present invention can be used to selectively kill cells infected by viruses or microorganisms, or otherwise selectively kill cells expressing a particular extracellular target biomolecule, such as a cell surface biomolecule. The cell-targeting molecules and pharmaceutical compositions of the present invention have varied applications, including, e.g., uses in depleting unwanted cell-types from tissues either in vitro or in vivo, uses as antiviral agents, uses as anti-parasitic agents, and uses in purging transplantation tissues of unwanted cell-types. In certain embodiments, a cell-targeting molecule and/or pharmaceutical composition of the present invention can be used to kill specific cell-types in a mixture of different cell-types, such as pre-administration tissue material for therapeutic purposes, e.g., pre-transplantation tissues. In certain embodiments, a cell-targeting molecule or pharmaceutical composition of the present invention can be used to selectively kill cells infected by viruses or microorganisms, or otherwise selectively kill cells expressing a particular extracellular target biomolecule, such as a cell surface biomolecule.

The present invention provides a method of killing a cell in a patient in need thereof, the method comprising the step of administering to the patient at least one cell-targeting molecule of the present invention or a pharmaceutical composition thereof. In certain embodiments of the cell-targeting molecule of the present invention, or pharmaceutical compositions thereof, can be used to kill an infected cell in a patient by targeting an extracellular biomolecule found physically coupled with an infected cell.

In certain embodiments, the cell-targeting molecule of the present invention or pharmaceutical compositions thereof can be used to kill a cancer cell in a patient by targeting an extracellular biomolecule found physically coupled with a cancer or tumor cell. The terms "cancer cell" or "cancerous cell" refers to various neoplastic cells which grow and divide in an abnormally accelerated and/or unregulated fashion and will be clear to the skilled person. The term "tumor cell" includes both malignant and non-malignant cells. Generally, cancers and/or tumors can be defined as diseases, disorders, or conditions that are amenable to treatment and/or prevention. The cancers and tumors (either malignant or non-malignant) which are comprised of cancer cells and/or tumor cells which may benefit from methods and compositions of the invention will be clear to the skilled person. Neoplastic cells are often associated with one or more of the following: unregulated growth, lack of differentiation, local tissue invasion, angiogenesis, and metastasis. The diseases, disorders, and conditions resulting from cancers and/or tumors (either malignant or non-malignant) which may benefit from the methods and compositions of the present invention targeting certain cancer cells and/or tumor cells will be clear to the skilled person.

Certain embodiments of the cell-targeting molecules and compositions of the present invention may be used to kill cancer stem cells, tumor stem cells, pre-malignant cancer-initiating cells, and tumor-initiating cells, which commonly are slow dividing and resistant to cancer therapies like chemotherapy and radiation. For example, acute myeloid leukemias (AMLs) may be treated with the present invention by killing AML stem cells and/or dormant AML progenitor cells (see e.g. Shlush L et al., Blood 120: 603-12 (2012)). Cancer stem cells often overexpress cell surface targets, such as, e.g., CD44, CD200, and others listed herein, which can be targets of certain binding regions of certain embodiments of the cell-targeting molecules of the present invention (see e.g. Kawasaki B et al., Biochem Biophys Res Commun 364:778-82 (2007); Reim F et al., CancerRes 69: 8058-66 (2009)).

Because of the unique Shiga toxin A Subunit based mechanism of action, compositions of matter of the present invention may be more effectively used in methods involving their combination with, or in complementary fashion with other therapies, such as, e.g., chemotherapies, immunotherapies, radiation, stem cell transplantation, and immune checkpoint inhibitors, and/or effective against chemoresistant/radiation-resistant and/or resting tumor cells/tumor initiating cells/stem cells. Similarly, compositions of matter of the present invention may be more effectively used in methods involving in combination with other cell-targeted therapies targeting other than the same epitope on, non-overlapping, or different targets for the same disease disorder or condition.

Certain embodiments of the cell-targeting molecules of the present invention, or pharmaceutical compositions thereof, can be used to kill an immune cell (whether healthy or malignant) in a patient by targeting an extracellular biomolecule found physically coupled with an immune cell.

It is within the scope of the present invention to utilize a cell-targeting molecule of the present invention, or pharmaceutical composition thereof, for the purposes of purging cell populations (e.g. bone marrow) of malignant and/or neoplastic cells and then reinfusing the target-cell-depleted material into a patient in need thereof.

Additionally, the present invention provides a method of treating a disease, disorder, or condition in a patient comprising the step of administering to a patient in need thereof a therapeutically effective amount of at least one of the cell-targeting molecules of the present invention, or a pharmaceutical composition thereof. Contemplated diseases, disorders, and conditions that can be treated using this method include cancers, malignant tumors, non-malignant tumors, growth abnormalities, immune disorders, and microbial infections. Administration of a "therapeutically effective dosage" of a composition of the present invention can result in a decrease in severity of disease symptoms, an increase in frequency and duration of disease symptom-free periods, or a prevention of impairment or disability due to the disease affliction.

The therapeutically effective amount of a composition of the present invention will depend on the route of administration, the type of subject being treated, and the physical characteristics of the specific patient under consideration. These factors and their relationship to determining this amount are well known to skilled practitioners in the medical arts. This amount and the method of administration can be tailored to achieve optimal efficacy, and may depend on such factors as weight, diet, concurrent medication and other factors, well known to those skilled in the medical arts. The dosage sizes and dosing regimen most appropriate for human use may be guided by the results obtained by the present invention, and may be confirmed in properly designed clinical trials. An effective dosage and treatment protocol may be determined by conventional means, starting with a low dose in laboratory animals and then increasing the dosage while monitoring the effects, and systematically varying the dosage regimen as well. Numerous factors may be taken into consideration by a clinician when determining an optimal dosage for a given subject. Such considerations are known to the skilled person.

An acceptable route of administration may refer to any administration pathway known in the art, including but not limited to aerosol, enteral, nasal, ophthalmic, oral, parenteral, rectal, vaginal, or transdermal (e.g. topical administration of a cream, gel or ointment, or by means of a transdermal patch). "Parenteral administration" is typically associated with injection at or in communication with the intended site of action, including infraorbital, infusion, intraarterial, intracapsular, intracardiac, intradermal, intramuscular, intraperitoneal, intrapulmonary, intraspinal, intrasternal, intrathecal, intrauterine, intravenous, subarachnoid, subcapsular, subcutaneous, transmucosal, or transtracheal administration.

For administration of a pharmaceutical composition of the present invention, the dosage range will generally be from about 0.001 to 10 milligrams per kilogram (mg/kg), and more, usually 0.001 to 0.5 mg/kg, of the subject's body weight. Exemplary dosages may be 0.01 mg/kg body weight, 0.03 mg/kg body weight, 0.07 mg/kg body weight, 0.09 mg/kg body weight or 0.1 mg/kg body weight or within the range of 1-10 mg/kg. An exemplary treatment regime is a once or twice daily administration, or a once or twice weekly administration, once every two weeks, once every three weeks, once every four weeks, once a month, once every two or three months or once every three to 6 months. Dosages may be selected and readjusted by the skilled health care professional as required to maximize therapeutic benefit for a particular patient.

Pharmaceutical compositions of the present invention will typically be administered to the same patient on multiple occasions. Intervals between single dosages can be, for example, 2-5 days, weekly, monthly, every two or three months, every six months, or yearly. Intervals between administrations can also be irregular, based on regulating blood levels or other markers in the subject or patient. Dosage regimens for a composition of the present invention include intravenous administration of 1 mg/kg body weight or 3 mg/kg body weight with the composition administered every two to four weeks for six dosages, then every three months at 3 mg/kg body weight or 1 mg/kg body weight.

A pharmaceutical composition of the present invention may be administered via one or more routes of administration, using one or more of a variety of methods known in the art. As will be appreciated by the skilled worker, the route and/or mode of administration will vary depending upon the desired results. Routes of administration for cell-targeting molecules, pharmaceutical compositions, and diagnostic compositions of the present invention include, e.g. intravenous, intramuscular, intradermal, intraperitoneal, subcutaneous, spinal, or other parenteral routes of administration, for example by injection or infusion. For other embodiments, a cell-targeting molecules, pharmaceutical composition, and diagnostic composition of the present invention may be administered by a non-parenteral route, such as a topical, epidermal or mucosal route of administration, for example, intranasally, orally, vaginally, rectally, sublingually, or topically.

Therapeutic cell-targeting molecules of the present invention, or pharmaceutical compositions thereof, may be administered with one or more of a variety of medical devices known in the art. For example, in one embodiment, a pharmaceutical composition of the invention may be administered with a needleless hypodermic injection device. Examples of well-known implants and modules useful in the present invention are in the art, including e.g., implantable micro-infusion pumps for controlled rate delivery; devices for administering through the skin; infusion pumps for delivery at a precise infusion rate; variable flow implantable infusion devices for continuous drug delivery; and osmotic drug delivery systems. These and other such implants, delivery systems, and modules are known to those skilled in the art.

In certain embodiments, a cell-targeting molecule or pharmaceutical composition of the present invention, alone or in combination with other compounds or pharmaceutical compositions, can show potent cell-kill activity when administered to a population of cells, in vitro or in vivo in a subject such as in a patient in need of treatment. By targeting the delivery of the Shiga toxin effector polypeptide associated with a heterologous CD8+ T-cell epitope cargo using high-affinity binding regions to specific cell-types, Shiga toxin effector and/or CD8+ T-cell epitope presentation mediated cell-killing activities can be restricted to specifically and selectively kill certain cell-types within an organism, such as certain cancer cells, neoplastic cells, malignant cells, non-malignant tumor cells, or infected cells.

The cell-targeting molecule of the present invention, or pharmaceutical composition thereof, may be administered alone or in combination with one or more other therapeutic or diagnostic agents. A combination therapy may include a cell-targeting molecule of the present invention, or pharmaceutical composition thereof, combined with at least one other therapeutic agent selected based on the particular patient, disease or condition to be treated. Examples of other such agents include, inter alia, a cytotoxic, anti-cancer or chemotherapeutic agent, an anti-inflammatory or anti-proliferative agent, an antimicrobial or antiviral agent, growth factors, cytokines, an analgesic, a therapeutically active small molecule or polypeptide, a single chain antibody, a classical antibody or fragment thereof, or a nucleic acid molecule which modulates one or more signaling pathways, and similar modulating therapeutic molecules which may complement or otherwise be beneficial in a therapeutic or prophylactic treatment regimen.

Treatment of a patient with a cell-targeting molecule or pharmaceutical composition of the present invention preferably leads to cell death of targeted cells and/or the inhibition of growth of targeted cells. As such, cell-targeting molecules of the present invention, and pharmaceutical compositions comprising them, will be useful in methods for treating a variety of pathological disorders in which killing or depleting target cells may be beneficial, such as, inter alia, cancers, tumors, growth abnormalities, immune disorders, and infected cells. The present invention provides methods for suppressing cell proliferation and treating cell disorders, including neoplasia and/or unwanted proliferation of certain cell-types.

In certain embodiments, the cell-targeting molecules and pharmaceutical compositions of the present invention can be used to treat or prevent cancers, tumors (malignant and non-malignant), growth abnormalities, immune disorders, and microbial infections. In a further aspect, the above ex vivo method can be combined with the above in vivo method to provide methods of treating or preventing rejection in bone marrow transplant recipients, and for achieving immunological tolerance.

In another aspect, certain embodiments of the cell-targeting molecules and pharmaceutical compositions of the present invention are endocrine regulating agents—meaning they are capable of treating and/or preventing the acquisition, development, or consequences of endocrine disorders resulting from endocrine gland hyposecretion, endocrine gland hypersecretion and/or endocrine glandular tumors. In certain further embodiments, the cell-targeting molecule of the present invention comprises a binding region which is a hormone or hormone analog. In certain further embodiments, the cell-targeting molecule of the present invention is used in a method of reducing endocrine gland hypersecretion by targeting and killing endocrine gland cells. The cell-targeting molecules and/or pharmaceutical compositions of the present invention may be utilized in a method of treating an endocrine disease comprising the step of administering to a patient, in need thereof, a therapeutically effective amount of a cell-targeting molecule or pharmaceutical composition of the present invention. In certain further embodiments, the disease to be treated is hyperthyroidism and/or hyperparathyroidism.

In certain embodiments, the cell-targeting molecules and pharmaceutical compositions of the present invention are immunomodulatory agents—meaning they are capable of treating and/or preventing the acquisition, development, or consequences of immune disorders. In certain further embodiments, the cell-targeting molecule of the present invention comprises a binding region which binds the extracellular target biomolecule which is a T-cell receptor (TCR). In certain further embodiments, the cell-targeting molecule of the present invention comprises a binding region which is a MHC class I tetramer. In certain further embodiments, the cell-targeting molecule of the present invention is used in a method of reducing the activity and/or viability of specific CD8+ cytotoxic T lymphocyte(s) involved in an autoimmune disorder. The cell-targeting molecules and/or pharmaceutical compositions of the present invention may be utilized in a method of treating an immune disorder comprising the step of administering to a patient, in need thereof, a therapeutically effective amount of a cell-targeting molecule or pharmaceutical composition of the present invention. In certain further embodiments, the disorder to be treated is the result of tissue destruction by CD8+ T lymphocytes, such as, e.g., as a result of allograft-related disease.

The cell-targeting molecules and pharmaceutical compositions of the present invention are commonly anti-neoplastic agents—meaning they are capable of treating and/or preventing the development, maturation, or spread of neoplastic or malignant cells by inhibiting the growth and/or causing the death of cancer or tumor cells. In certain embodiments, the present invention provides methods for treating malignancies or neoplasms and other blood cell associated cancers in a mammalian subject, such as a human, the method comprising the step of administering to a subject in need thereof a therapeutically effective amount of a cell-targeting molecule or pharmaceutical composition of the invention.

In another aspect, certain embodiments of the cell-targeting molecules and pharmaceutical compositions of the present invention are antimicrobial agents—meaning they are capable of treating and/or preventing the acquisition, development, or consequences of microbiological pathogenic infections, such as caused by viruses, bacteria, fungi, prions, or protozoans.

The cell-targeting molecules and/or pharmaceutical compositions of the present invention may be utilized in a method of treating cancer comprising administering to a patient, in need thereof, a therapeutically effective amount of a cell-targeting molecule or pharmaceutical composition of the present invention. In certain embodiments of the methods of the present invention, the cancer being treated is selected from the group consisting of: bone cancer (such as multiple myeloma or Ewing's sarcoma), breast cancer, central/peripheral nervous system cancer (such as brain cancer, neurofibromatosis, or glioblastoma), gastrointestinal cancer (such as stomach cancer or colorectal cancer), germ cell cancer (such as ovarian cancers and testicular cancers, glandular cancer (such as pancreatic cancer, parathyroid cancer, pheochromocytoma, salivary gland cancer, or thyroid cancer), head-neck cancer (such as nasopharyngeal cancer, oral cancer, or pharyngeal cancer), hematological cancers (such as leukemia, lymphoma, or myeloma), kidney-urinary tract cancer (such as renal cancer and bladder cancer), liver cancer, lung/pleura cancer (such as mesothelioma, small cell lung carcinoma, or non-small cell lung carcinoma), prostate cancer, sarcoma (such as angiosarcoma, fibrosarcoma, Kaposi's sarcoma, or synovial sarcoma), skin cancer (such as basal cell carcinoma, squamous cell carcinoma, or melanoma), and uterine cancer.

The cell-targeting molecules and pharmaceutical compositions of the present invention may be utilized in a method of treating an immune disorder comprising administering to a patient, in need thereof, a therapeutically effective amount of the cell-targeting molecule or pharmaceutical composition of the present invention. In certain embodiments of the methods of the present invention, the immune disorder is related to an inflammation associated with a disease selected from the group consisting of: amyloidosis, ankylosing spondylitis, asthma, autism, cardiogenesis, Crohn's disease, diabetes, erythematosus, gastritis, graft rejection, graft-versus-host disease, Grave's disease, Hashimoto's thyroiditis, hemolytic uremic syndrome, HIV-related diseases, lupus erythematosus, lymphoproliferative disorders, multiple sclerosis, myasthenia gravis, neuroinflammation, polyarteritis nodosa, polyarthritis, psoriasis, psoriatic arthritis, rheumatoid arthritis, scleroderma, septic shock, Sjorgren's syndrome, systemic lupus erythematosus, ulcerative colitis, vasculitis.

Among certain embodiments of the present invention is using the cell-targeting molecule of the present invention as a component of a pharmaceutical composition or medicament for the treatment or prevention of a cancer, tumor, other growth abnormality, immune disorder, and/or microbial infection. For example, immune disorders presenting on the skin of a patient may be treated with such a medicament in efforts to reduce inflammation. In another example, skin tumors may be treated with such a medicament in efforts to reduce tumor size or eliminate the tumor completely.

Among certain embodiments of the present invention is a method of using a cell-targeting molecule, pharmaceutical composition, and/or diagnostic composition of the present invention for the purpose of information gathering regarding diseases, conditions and/or disorders. For example, the cell-targeting molecule of the present invention may be used for imaging of pMHC I presentation by tumor cells using antibodies specific to certain pMHC Is. The detection of such labeled target cells after being treated with a cell-targeting molecule of the present invention may provide a readout regarding a targeted cell-type's competency at antigen processing and MHC class I presentation as well as the percentage of such competent target cells within a population of target cells when combined with readouts from diagnostic variants of the cell-targeting molecules of the invention.

Among certain embodiments of the present invention is a method of using a cell-targeting molecule, pharmaceutical composition, and/or diagnostic composition of the present invention to detect the presence of a cell-type for the purpose of information gathering regarding diseases, conditions and/or disorders. The method comprises contacting a cell with a diagnostically sufficient amount of a cell-targeting molecule of the present invention in order to detect the molecule by an assay or diagnostic technique. The phrase "diagnostically sufficient amount" refers to an amount that provides adequate detection and accurate measurement for information gathering purposes by the particular assay or diagnostic technique utilized. Generally, the diagnostically sufficient amount for whole organism in vivo diagnostic use will be a non-cumulative dose of between 0.01 mg to 10 mg of the detection promoting agent linked cell-targeting molecule of the invention per kg of subject per subject. Typically, the amount of cell-targeting molecule of the invention used in these information-gathering methods will be as low as possible provided that it is still a diagnostically sufficient amount. For example, for in vivo detection in an organism, the amount of cell-targeting molecule or diagnostic composition of the invention administered to a subject will be as low as feasibly possible.

The cell-type specific targeting of cell-targeting molecules of the present invention combined with detection promoting agents provides a way to detect and image cells physically coupled with an extracellular target biomolecule of a binding region of the molecule of the invention. Alternatively, the display of a cell-targeting molecule delivered heterologous, CD8+ T-cell epitope cargo can provide a way to detect and image cells which internalized a cell-targeting molecule of the present invention. Imaging of cells using the cell-targeting molecules and diagnostic compositions of the present invention may be performed in vitro or in vivo by any suitable technique known in the art. Diagnostic information may be collected using various methods known in the art, including whole body imaging of an organism or using ex vivo samples taken from an organism. The term "sample" used herein refers to any number of things, but not limited to, fluids such as blood, urine, serum, lymph, saliva, anal secretions, vaginal secretions, and semen, and tissues obtained by biopsy procedures. For example, various detection promoting agents may be utilized for non-invasive in vivo tumor imaging by techniques such as magnetic resonance imaging (MRI), optical methods (such as direct, fluorescent, and bioluminescent imaging), positron emission tomography (PET), single-photon emission computed tomography (SPECT), ultrasound, x-ray computed tomography, and combinations of the aforementioned (see, Kaur S et al., *Cancer Lett* 315: 97-111 (2012), for review).

Among certain embodiment of the present invention is a method of using a cell-targeting molecule, pharmaceutical composition, and/or diagnostic composition of the present invention to label or detect the interiors of neoplastic cells and/or immune cell-types (see e.g., Koyama Y et al., *Clin Cancer Res* 13: 2936-45 (2007); Ogawa M et al., *Cancer Res* 69: 1268-72 (2009); Yang L et al., *Small* 5: 235-43 (2009)). This may be based on the ability of certain cell-targeting molecules of the present invention to enter specific cell-types and route within cells via retrograde intracellular transport to specific subcellular compartments such that interior compartments of specific cell-types are labeled for detection. This can be performed on cells in situ within a patient or in vitro on cells and tissues removed from an organism, e.g. biopsy materials.

Diagnostic compositions of the present invention may be used to characterize a disease, disorder, or condition as potentially treatable by a related pharmaceutical composition of the present invention. Certain compositions of matter of the present invention may be used to determine whether a patient belongs to a group that responds to a therapeutic strategy which makes use of a cell-targeting molecule of the invention, or composition thereof, or related method of the present invention as described herein or is well suited for using a delivery device of the invention.

Diagnostic compositions of the present invention may be used after a disease, e.g. a cancer, is detected in order to better characterize it, such as to monitor distant metastases, heterogeneity, and stage of cancer progression. The phenotypic assessment of disease disorder or infection can help prognostic and prediction during therapeutic decision making. In disease reoccurrence, certain methods of the invention may be used to determine if a localized or systemic problem.

Diagnostic compositions of the present invention may be used to assess responses to therapeutic(s) regardless of the type of therapeutic, e.g. small molecule drug, biological drug, or cell-based therapy. For example, certain embodiments of the diagnostic compositions of the invention may be used to measure changes in tumor size, changes in antigen positive cell populations including number and distribution, or monitoring a different marker than the antigen targeted by a therapy already being administered to a patient (see Smith-Jones P et al., *Nat. Biotechnol* 22: 701-6 (2004); Evans M et al., *Proc. Natl. Acad. Sci. U.S.A.* 108: 9578-82 (2011)).

Diagnostic compositions of the present invention may be used to assess the MHC class I system functionality in target cell-types. For example, certain malignant cells, such as infected, tumor, or cancer cells, can exhibit alterations, defects, and perturbations to their MHC class I presentation pathways. This can be studied in vitro or in vivo. Diagnostic compositions of the invention may be used to monitor changes in MHC class I presentation among individual cells within a population of target cells within an organism or to count or determine percentages of MHC class I presentation defective target cells within an organism, tumor biopsy, etc.

In certain embodiments of the method used to detect the presence of a cell-type may be used to gather information regarding diseases, disorders, and conditions, such as, for example bone cancer (such as multiple myeloma or Ewing's sarcoma), breast cancer, central/peripheral nervous system cancer (such as brain cancer, neurofibromatosis, or glioblastoma), gastrointestinal cancer (such as stomach cancer or colorectal cancer), germ cell cancer (such as ovarian cancers and testicular cancers, glandular cancer (such as pancreatic cancer, parathyroid cancer, pheochromocytoma, salivary gland cancer, or thyroid cancer), head-neck cancer (such as nasopharyngeal cancer, oral cancer, or pharyngeal cancer), hematological cancers (such as leukemia, lymphoma, or myeloma), kidney-urinary tract cancer (such as renal cancer and bladder cancer), liver cancer, lung/pleura cancer (such as mesothelioma, small cell lung carcinoma, or non-small cell lung carcinoma), prostate cancer, sarcoma (such as angiosarcoma, fibrosarcoma, Kaposi's sarcoma, or synovial sarcoma), skin cancer (such as basal cell carcinoma, squamous cell carcinoma, or melanoma), uterine cancer, AIDS, amyloidosis, ankylosing spondylitis, asthma, autism, cardiogenesis, Crohn's disease, diabetes, erythematosus, gastritis, graft rejection, graft-versus-host disease, Grave's disease, Hashimoto's thyroiditis, hemolytic uremic syndrome, HIV-related diseases, lupus erythematosus, lymphoproliferative disorders, multiple sclerosis, myasthenia gravis, neuroinflammation, polyarteritis nodosa, polyarthritis, psoriasis, psoriatic arthritis, rheumatoid arthritis, scleroderma, septic shock, Sjorgren's syndrome, systemic lupus erythematosus, ulcerative colitis, vasculitis, cell proliferation, inflammation, leukocyte activation, leukocyte adhesion, leukocyte chemotaxis, leukocyte maturation, leukocyte migration, neuronal differentiation, acute lymphoblastic leukemia (ALL), T acute lymphocytic leukemia/lymphoma (ALL), acute myelogenous leukemia, acute myeloid leukemia (AML), B-cell chronic lymphocytic leukemia (B-CLL), B-cell prolymphocytic lymphoma, Burkitt's lymphoma (BL), chronic lymphocytic leukemia (CLL), chronic myelogenous leukemia (CML-BP), chronic myeloid leukemia (CML), diffuse large B-cell lymphoma, follicular lymphoma, hairy cell leukemia (HCL), Hodgkin's Lymphoma (HL), intravascular large B-cell lymphoma, lymphomatoid granulomatosis, lymphoplasmacytic lymphoma, MALT lymphoma, mantle cell lymphoma, multiple myeloma (MM), natural killer cell leukemia, nodal marginal B-cell lymphoma, Non-Hodgkin's lymphoma (NHL), plasma cell leukemia, plasmacytoma, primary effusion lymphoma, pro-lymphocytic leukemia, promyelocytic leukemia, small lymphocytic lymphoma, splenic marginal zone lymphoma, T-cell lymphoma (TCL), heavy chain disease, monoclonal gammopathy, monoclonal immunoglobulin deposition disease, myelodusplastic syndromes (MDS), smoldering multiple myeloma, and Waldenström macroglobulinemia.

In certain embodiments, the cell-targeting molecules of the present invention, or pharmaceutical compositions thereof, are used for both diagnosis and treatment, or for diagnosis alone. In some situations, it would be desirable to determine or verify the HLA variant(s) and/or HLA alleles expressed in the subject and/or diseased tissue from the subject, such as, e.g., a patient in need of treatment, before selecting a cell-targeting molecule of the invention for use in treatment(s). In some situations, it would be desirable to determine, for an individual subject, the immunogenicity of certain CD8+ T-cell epitopes before selecting which cell-targeting molecule, or composition thereof, to use in a method of the present invention.

The present invention is further illustrated by the following non-limiting examples of cell-targeting molecules comprising the aforementioned structures and functions, in particular the function of extracellular targeting the delivery of a CD8+ T-cell epitope cargo to specific cells and then intracellular delivery of the CD8+ T-cell epitope cargo to the MHC class I pathway for presentation of the delivered CD8+ T-cell epitope cargo complexed with MHC class I molecules on a cell surface.

EXAMPLES

De-immunized, Shiga toxin effector polypeptides can be engineered to deliver immunogenic epitope-peptides for presentation by cells in which these polypeptides are present. Furthermore, de-immunized, Shiga toxin effector polypeptides that are furin-cleavage resistant can also be engineered to deliver immunogenic epitope-peptides for presentation by target cells. Cell-targeting molecules comprising such de-immunized, Shiga toxin effector polypeptides provide for the targeted delivery of epitopes to specific cells and may be used in applications involving cell-type specific presentation of immuno-stimulatory epitopes within a chordate. The presentation of a T-cell immunogenic epitope by the MHC class I system within a chordate targets the epitope presenting cell for killing by CD8+ CTL-mediated lysis and may also stimulate other immune responses in the vicinity.

In the Examples, CD8+ T-cell antigens were fused to cell-targeting molecules comprising de-immunized and furin-cleavage resistant Shiga toxin A Subunit effector polypeptides. All these fusion polypeptides involve the addition of at least one peptide to the starting polypeptide scaffold and do not require the embedding or inserting of any heterologous, CD8+ T-cell epitope internally within a Shiga toxin effector polypeptide component, although other embedded or inserted heterologous, CD8+ T-cell epitope may be present in the deimmunized, Shiga toxin effector polypeptide. Thus, in certain exemplary cell-targeting molecules of the present invention, the Shiga toxin effector polypeptide consists of a de-immunized Shiga toxin polypeptide that may further be furin-cleavage resistant and/or comprise one or more embedded or inserted CD8+ T-cell epitopes.

The Examples below describe exemplary, cell-targeting molecules of the present invention comprising (1) an immunoglobulin-type binding region for cell-targeting, (2) a de-immunized and furin-cleavage resistant Shiga toxin effector polypeptide, and (3) a cargo consisting of a fused, heterologous, CD8+ T-cell epitope-peptide which is neither embedded nor inserted into a Shiga toxin effector polypeptide region. These exemplary, cell-targeting molecules of the present invention bind to target biomolecules expressed by targeted cell-types and enter targeted cells. Then, the internalized exemplary cell-targeting molecules effectively route their Shiga toxin effector polypeptide components to the cytosol and optionally kill target cells directly via ribosome inhibition.

The Examples below demonstrate that an exemplary cell-targeting molecule delivered, within target cells, its fused, heterologous, CD8+ T-cell epitope-peptide cargo to the MHC class I pathway resulting in presentation of the T-cell epitope-peptide on the surface of target cells. The cell-surface display of delivered T-cell epitopes complex to MHC class I molecules by a target cell can signal to CD8+ effector T-cells to kill the epitope-displaying target cells as well as stimulate other immune responses in the vicinity of the epitope-displaying target cell.

As demonstrated below in Example 1, a cell-targeting molecule of the present invention was capable, upon exogenous administration, of delivering a heterologous, T-cell epitope-peptide to the MHC class I pathway for presentation by targeted, human, cancer cells. Also demonstrated below in Examples 1-2, two cell-targeting molecules of the present invention were capable of specifically killing target-expressing human, cancer cells via their de-immunized and furin-cleavage resistant Shiga toxin effector polypeptide components. Further demonstrated below in Example 2, two other cell-targeting molecules of the present invention were capable of killing target-expressing human, cancer cells via the action of immune cells in human PBMC coculture experiments. In addition, Example 2 demonstrates that a catalytically active cell-targeting molecule of the present invention can kill more target-expressing human cancer cells cocultured with human PBMCs than a catalytically active reference molecule lacking any heterologous CD8+ T-cell epitope-cargo-suggesting that inducing both direct cell-kill and indirect intercellular T-cell killing mechanisms can achieve greater target cell-killing in the presence of the appropriate MHC class I epitope-specific restricted T-cells.

Example 1. Cell-Targeting Molecules Comprising De-Immunized and Furin-Cleavage Resistant, Shiga Toxin A Subunit Derived Polypeptides and Fused, T-Cell Epitope-Peptides Cell-targeting molecules are created and tested—the cell-targeting molecules each comprising 1) a cell-targeting binding region, 2) a de-immunized Shiga toxin effector polypeptide which is optionally furin-cleavage resistant, and 3) at least one T-cell epitope-peptide cargo consisting of a fused, heterologous, CD8+ T-cell epitope-peptide which is neither embedded nor inserted into a Shiga toxin effector polypeptide region. Previously, Shiga toxin A Subunit derived, cell-targeting molecules have been constructed and shown to promote cellular internalization and direct intracellular routing of their Shiga toxin effector polypeptide components to the cytosol (see e.g. WO 2014/164680, WO 2014/164693, WO 2015/138435, WO 2015/138452, WO 2015/113005, WO 2015/113007, WO 2015/191764, WO 2016/196344, and PCT/US2017/065074). T-cell epitope-peptides are fused to modular polypeptide components of these de-immunized and/or furin-cleavage resistant Shiga toxin A Subunit derived, cell-targeting molecules in order to create novel cell-targeting molecules each having at least one T-cell epitope-peptide that is neither embedded nor inserted into a Shiga toxin A1 fragment derived component and which is heterologous to the Shiga toxin A subunit component (see e.g. WO 2017/019623).

As demonstrated below in this Example, a cell-targeting protein of the present invention was capable, upon exogenous administration, of delivering a heterologous, T-cell epitope-peptide to the MHC class I pathway for presentation by targeted, human, cancer cells. Also demonstrated below in this Example, a cell-targeting protein of the present invention was capable of specifically killing target-expressing human, cancer cells via its de-immunized and furin-cleavage resistant Shiga toxin effector polypeptide component. The cell-targeting binding region of the exemplary cell-targeting protein of this Example was capable of exhibiting high-affinity binding to an extracellular target biomolecule physically-coupled to the surface of a specific cell-type(s). The exemplary cell-targeting protein of this Example is capable of selectively targeting cells expressing a target biomolecule of their cell-targeting binding region and internalizing into these target cells.

I. Construction of Exemplary Cell-Targeting Molecules of the Present Invention Using techniques known in the art, exemplary cell-targeting fusion proteins are created by genetically fusing a human CD8+ T-cell epitope-peptide to the amino terminus (N-terminus) or carboxy terminus (C-terminus) of a polypeptide component of a parental, cell-targeting protein comprising 1) a de-immunized and furin-cleavage resistant Shiga toxin A Subunit effector polypeptide and 2) a cell-targeting binding region polypeptide separated by a proteinaceous linker. The fused, CD8+ T-cell epitope cargos are chosen from among several T-cell epitope-peptides originating in viruses that commonly infect humans. The resulting cell-targeting, fusion proteins are constructed such that each comprised a single, continuous polypeptide comprising a cell-targeting, binding region polypeptide, a de-immunized and furin-cleavage resistant Shiga toxin A Subunit effector polypeptide, and a fused, heterologous, CD8+ T-cell epitope cargo.

A cell-targeting molecule of the present invention may comprise (1) an immunoglobulin-type binding region for cell-targeting, (2) a de-immunized and furin-cleavage resistant Shiga toxin effector polypeptide, and (3) a cargo consisting of a fused, heterologous, CD8+ T-cell epitope-peptide which is neither embedded nor inserted into a Shiga toxin effector polypeptide region. All three components may be chosen from the prior art or created using routine methods known to the skilled worker (see e.g. WO 2014/164680, WO 2014/164693, WO 2015/138435, WO 2015/138452, WO 2015/113005, WO 2015/113007, WO 2015/191764, WO 2016/196344, and PCT/US2017/065074).

Immunoglobulin-type binding regions have been described previously in WO 2014/164680, WO 2014/164693, WO 2015/138435, WO 2015/138452, WO 2015/113005, WO 2015/113007, WO 2015/191764, and WO 2016/196344.

De-immunized and furin-cleavage resistant, Shiga toxin effector polypeptides have been described previously in WO 2015/113007, WO 2015/191764, and WO 2016/196344.

Heterologous, CD8+ T-cell epitope-peptides have been described previously in WO 2015/113005 and WO 2016/196344.

In this Example, proteinaceous linkers are selected from the prior art to link the components.

All the Shiga toxin effector polypeptide components of the cell-targeting molecules of this Example are derived from amino acids 1-251 of SLT-1A (SEQ ID NO:1), and some of them contained two or more amino acid residue substitutions relative to a wild-type Shiga toxin A Subunit, such as, e.g., de-immunizing substitutions and/or substitutions furin-cleavage motif disrupting mutations (see e.g. WO 2015/113007, WO 2015/191764, and WO 2016/196344). Exemplary, Shiga toxin effector polypeptide components of the cell-targeting molecules of the invention are SEQ ID NOs: 29-38.

All of the cell-targeting molecules tested in the experiments of this Example were produced in a bacterial system and purified by column chromatography using techniques known to the skilled worker.

The exemplary cell-targeting molecule of the present invention that was produced and tested in this Example was SLT-1A-DI-FR::scFv1::C2 (SEQ ID NO:252). This exemplary, cell-targeting, fusion protein of the present invention comprised a cell-targeting binding region comprising a single-chain variable fragment component (scFv1), a de-immunized and furin-cleavage resistant Shiga toxin A Subunit effector polypeptide component (SLT-1A-DI-FR), and a human CD8+ T-cell epitope-peptide (C2) fused to the binding region. The immunoglobulin-type binding region scFv1 is a single-chain variable fragment which bound with high-affinity to a certain cell-surface, target biomolecule physically coupled to the surface of certain human cancer cells. The Shiga toxin effector polypeptide component of the cell-targeting molecule of this Example was SLT-1A-DI-FR (SEQ ID NO:29). The epitope-peptide C2 (SEQ ID NO:21) selected as a fused cargo was known to be immunogenic. The cell-targeting molecule SLT-1A-DI-FR::scFv1::C2 (SEQ ID NO:252) was produced in a bacterial system and purified by column chromatography using techniques known to the skilled worker.

After purification, the multimeric state of the cell-targeting molecule SLT-1A-DI-FR::scFv1::C2 (SEQ ID NO:252) was tested using both size-exclusion chromatography (SEC) and sodium dodecyl sulfate polyacrylamide gel electrophoresis (SDS-PAGE) under denaturing conditions.

A sample of SLT-1A-DI-FR::scFv1 protein (SEQ ID NO:258) was analyzed by SEC using a Superdex 200 30/300 column (GE Healthcare, Little Chalfont, Buckinghamshire, U.K.) having a 24-mL bed volume. The sample was loaded onto the column and at least 24 mL of buffer was flowed over the column while an ultraviolet light (UV) detector monitored the elution of protein from by absorbance at 280 nm reported as milli-absorbance units (mAU). Molecules with smaller molecular weights are retarded when flowing through matrixes used for size exclusion chromatography as compared to larger molecules and therefore small molecules exhibit longer size exclusion chromatography retention times than larger molecules. Using the elution rates of proteins of known molecular masses subjected to size exclusion chromatography with the same column and conditions as references, the molecular mass of the SLT-1A-DI-FR::scFv1 protein (SEQ ID NO:258) sample under native conditions was estimated.

The SLT-1A-DI-FR::scFv1 (SEQ ID NO:258) sample analyzed produced a primary peak corresponding to a retention of 13.2 mL, which based on the reference proteins of known masses corresponds to a molecular mass of about 110 kiloDalton (kDa) (FIG. 4), which was consistent with a 110 kDa homodimeric protein comprising two polypeptides each having a mass of 55 kDa. By this SEC analysis, a sample of SLT-1A-DI-FR::scFv1::C2 protein (SEQ ID NO:252) is measured to be about the same size, which appears congruent with an approximately 110 kDa molecule consisting of two polypeptides each having a mass of 55 kDa (see below).

Protein samples of SLT-1A-DI-FR::scFv1::C2 (SEQ ID NO:252) and SLT-1A-DI-FR::scFv1 (SEQ ID NO:258) were loaded in equal amounts onto 4-20% sodium dodecyl sulfate (SDS) polyacrylamide gels (Lonza, Basel, CH) and electrophoresed under denaturing conditions (FIG. 5). The resulting gels were analyzed by Coomassie staining. A molecular weight (MW) marker (ProSeive™ QuadColor™, Lonza, Basel, CH) was loaded to indicate approximate molecular weight of the proteins loaded on the gel. Under these denaturing conditions, any multimeric protein complexes were expected to dissociate into monomeric polypeptides. Both SLT-1A-DI-FR::scFv1::C2 and SLT-1A-DI-FR::scFv1 samples formed bands with apparent molecular weights of about 55 kDa (FIG. 5), which corresponds to the approximate molecular weight of the protein mass predicted for either SLT-1A-DI-FR::scFv1::C2 (SEQ ID NO:252) or SLT-1A-DI-FR::scFv1 (SEQ ID NO:258) for having 508 and 500 amino acids, respectively.

II. Testing the Shiga Toxin A Subunit Effector Polypeptide Components of Cell-Targeting Molecules for Retention of Shiga Toxin Functions after the Fusion of Binding Regions and T-Cell Epitope-Peptides Exemplary cell-targeting proteins are tested for retention of Shiga toxin A Subunit effector functions after the fusion of heterologous, CD8+ T-cell epitope-peptides. The Shiga toxin A Subunit effector functions analyzed were cytotoxicity, and by inference self-directing subcellular routing to the cytosol.

Testing the Cytotoxic Activities of Exemplary Cell-Targeting Molecules of the Invention The cytotoxic activities of exemplary cell-targeting molecules of the invention are measured using a tissue culture cell-based toxicity assay. The concentration of exogenously administered cell-targeting molecule which kills half the cells in a homogenous cell population (half-maximal cytotoxic concentration) was determined for certain cell-targeting molecules of the invention. The cytotoxicities of exemplary cell-targeting molecules are tested using cell-kill assays involving either target biomolecule positive or target biomolecule negative cells with respect to the target biomolecule of each cell-targeting molecule's binding region.

The target cells used in this Example (cell lines A, B, and C) were immortalized human cancer cells available from the ATCC (Manassas Va., U.S.) or the DSMZ (The Leibniz Deutsche Sammlung von Mikroorganismen und Zellkulture) (Braunschweig, Del.)).

The cell-kill assays were performed as follows. Human tumor cell line cells were plated (typically at $2\times10^3$ cells per well for adherent cells, plated the day prior to protein addition, or $7.5\times10^3$ cells per well for suspension cells, plated the same day as protein addition) in 20 µL cell culture medium in 384-well plates. A series of 10-fold dilutions of the proteins to be tested was prepared in an appropriate buffer, and 5 µL of the dilutions or only buffer as a negative control were added to the cells. Control wells containing only cell culture medium were used for baseline correction. The cell samples were incubated with the proteins or just buffer for 3 or 5 days at 37° C. and in an atmosphere of 5% carbon dioxide ($CO_2$). The total cell survival or percent viability was determined using a luminescent readout using the CellTiter-Glo® Luminescent Cell Viability Assay (G7573 Promega Madison, Wis., U.S.) according to the manufacturer's instructions as measured in relative light units (RLU).

The Percent Viability of experimental wells was calculated using the following equation: (Test RLU−Average Media RLU)÷(Average Cells RLU−Average Media RLU)× 100. Log protein concentration versus Percent Viability was plotted in Prism (GraphPad Prism, San Diego, Calif., U.S.) and log (inhibitor) versus response (3 parameter) analysis were used to determine the half-maximal cytotoxic concentration ($CD_{50}$) value for the tested proteins. The $CD_{50}$ values for each exemplary cell-targeting protein tested was calculated when possible.

The specificity of the cytotoxic activity of a given cell-targeting molecule was determined by comparing cell kill activities toward cells expressing a significant amount of a target biomolecule of the binding region of the cell-targeting molecule (target positive cells) with cell-kill activities toward cells which do not exhibit any significant amount of any target biomolecule of the binding region of the cell-targeting molecule physically coupled to any cellular surface (target negative cells). This was accomplished by determining the half-maximal cytotoxic concentrations of a given cell-targeting molecule of the invention toward cell populations which were positive for cell surface expression of the target biomolecule of the cell-targeting molecule being analyzed, and, then, using the same cell-targeting molecule concentration range to attempt to determine the half-maximal cytotoxic concentrations toward cell populations which were negative for cell surface expression of the target biomolecule of the cell-targeting molecule. In some experiments, the target negative cells treated with the maximum amount of the Shia-toxin containing molecule did not show any change in viability as compared to a "buffer only" negative control.

The cytotoxic activity levels of various molecules tested using the cell-kill assay described above are reported in Table 1. As reported in Table 1, exemplary cell targeting proteins of the invention which were tested in this assay exhibited potent cytotoxicity. While the fusion of a heterologous, CD8+ T-cell epitope-peptide to a Shiga toxin derived, cell-targeting protein can result in no change in cytotoxicity, some exemplary cell-targeting proteins exhibited reduced cytotoxicity as compared to the parental protein from which it was derived, which did not comprise any fused, heterologous epitope-peptide (Table 1). As reported in the Examples, a molecule exhibiting a $CD_{50}$ value within 10-fold of a $CD_{50}$ value measured for a reference molecule is considered to exhibit cytotoxic activity comparable to that reference molecule. In particular, any exemplary cell-targeting molecule of the present invention that exhibited a $CD_{50}$ value to a target positive cell population within 10-fold of the $CD_{50}$ value of a reference cell-targeting molecule comprising the same binding region and a wild-type, Shiga toxin effector polypeptide (e.g. SLT-1A-WT (SEQ ID NO:279)) but not comprising any fused, heterologous, T-cell epitope-peptide, toward the same cell-type is referred to herein as "comparable to wild-type." Cell-targeting molecules that exhibited a $CD_{50}$ value to a target positive cell population within 100-fold to 10-fold of a reference molecule comprising the same binding region and the same Shiga toxin effector polypeptide but not comprising any fused, heterologous, T-cell epitope-peptide is referred to herein as active but "attenuated."

TABLE 1

Cytotoxic Activities of Shiga Toxin Derived, Cell-Targeting Proteins Comprising Fused, Heterologous Epitope-Peptides

| Administered Molecule | Fused Epitope | Fusion Location | Cell Line A (target positive) | Cell Line B (target positive) | Cell Line C (target positive) |
|---|---|---|---|---|---|
| SLT-1A-DI-FR::scFv1::C2 | C2 | carboxy-terminus | 0.22 | 0.91 | 0.86 |
| SLT-1A-DI-FR::scFv1 | none | N/A | 0.022 | 0.21 | 0.18 |

Table 1 and FIG. 2 show that SLT-1A-DI-FR::scFv1::C2 (SEQ ID NO:252) exhibits a cytotoxicity to three different types of target positive cells with a similar cytotoxic activity to a parental protein lacking the fused antigen C2 (SEQ ID NO:258).

III. Testing Epitope-Peptide Delivery and Cell-Surface Presentation of Delivered Epitope-Peptides by Target Cells The successful delivery of a T-cell epitope can be determined by detecting specific cell surface, MHC class I molecule/epitope complexes (pMHC Is). In order to test whether a cell-targeting protein can deliver a fused T-cell epitope to the MHC class I presentation pathway of target cells, an assay was employed which detects human, MHC Class I molecules complexed with specific epitopes. A flow cytometry method was used to demonstrate delivery of a T-cell epitope (fused to a de-immunized and furin-cleavage resistant, Shiga toxin A Subunit derived cell-targeting protein) and extracellular display of the delivered T-cell epitope-peptide in complex with MHC Class I molecules on the surfaces of target cells. This flow cytometry method utilizes soluble human T-cell receptor (TCR) multimer reagents (Soluble T-Cell Antigen Receptor STAR™ Multimer, Altor Bioscience Corp., Miramar, Fla., U.S.), each with high-affinity binding to a different epitope-human HLA complex.

Each STAR™ TCR multimer reagent is derived from a specific T-cell receptor and allows detection of a specific peptide-MHC complex based on the ability of the chosen TCR to recognize a specific peptide presented in the context of a particular MHC class I molecule. These TCR multimers are composed of recombinant human TCRs which have been biotinylated and multimerized with streptavidin. The TCR multimers are labeled with phycoerythrin (PE). These TCR multimer reagents allow the detection of specific peptide-MHC Class I complexes presented on the surfaces of human cells because each soluble TCR multimer type recognizes and stably binds to a specific peptide-MHC complex under varied conditions (Zhu X et al., *J Immunol* 176: 3223-32 (2006)). These TCR multimer reagents allow the identification and quantitation by flow cytometry of peptide-MHC class I complexes present on the surfaces of cells.

The TCR CMV-pp65-PE STAR™ multimer reagent (Altor Bioscience Corp., Miramar, Fla., U.S.) was used in this Example. MHC class I pathway presentation of the human CMV C2 peptide (NLVPMVATV (SEQ ID NO:21)) by human cells expressing the HLA-A2 can be detected with the TCR CMV-pp65-PE STAR™ multimer reagent which exhibits high affinity recognition of the CMV-pp65 epitope-peptide (residues 495-503, NLVPMVATV (SEQ ID NO:21)) complexed to human HLA-A2 and is labeled with PE.

Using standard flow cytometry methods known in the art, the target cells were confirmed to express on their cell surfaces both the HLA-A2 MHC-Class I molecule and the extracellular target biomolecules of the cell-targeting proteins used in this Example. In some experiments, the human cancer cells were pretreated with human interferon gamma (IFN-γ) to enhance expression of human HLA-A2.

Sets of target cells were treated by exogenous administration of SLT-1A-DI-FR::scFv1::C2 (SEQ ID NO:252), a cell-targeting molecule comprising a carboxy-terminal fused, viral, CD8+ T-cell epitope, or were treated by exogenous administration of a negative-control cell-targeting fusion protein which did not comprise any fused, heterologous, viral epitope-peptide, SLTA-1A-DI-FR::scFv1 (SEQ ID NO:258). The cell-targeting molecules and reference molecules used in these experiments were both catalytically active, cytotoxic cell-targeting molecules. These treatments were at cell-targeting molecule concentrations similar to those used by others taking into account cell-type specific sensitivities to Shiga toxins (see e.g. WO 2015/113005). The treated cells were then incubated for 4-16 hours in standard conditions, including at 37° C. and an atmosphere with 5% carbon dioxide, to allow for intoxication mediated by a de-immunized and furin-cleavage resistant, Shiga toxin effector polypeptide. Then the cells were washed and incubated with the TCR CMV-pp65-PE STAR™ multimer reagent to "stain" C2 peptide-HLA-A2 complex-presenting cells.

As controls, sets of target cells are treated in three conditions: 1) without any treatment ("untreated") meaning there was addition of only buffer to the cells and no addition of any exogenous molecules, 2) with exogenously administered CMV C2 peptide (CMV-pp65, aa495-503: sequence NLVPMVATV (SEQ ID NO:21), synthesized by BioSynthesis, Lewisville, Tex., U.S.), and/or 3) with exogenously administered CMV C2 peptide ((SEQ ID NO:21), as above) combined with a Peptide Loading Enhancer ("PLE," Altor Biosicence Corp., Miramar, Fla., U.S.). The C2 peptide (SEQ ID NO:21) combined with PLE treatment allowed for exogenous peptide loading and served as a positive control. Cells displaying the appropriate MHC class I haplotype can be forced to load the appropriate exogenously applied peptide from an extracellular space (i.e. in the absence of cellular internalization of the applied peptide) or in the presence of PLE, which is a mixture of B2-microglobulin and other components.

After the treatments, all the sets of cells were washed and incubated with the TCR CMV-pp65-PE STAR™ multimer reagent for one hour on ice. The cells were washed and the fluorescence of the samples was measured by flow cytometry using an Accuri™ C6 flow cytometer (BD Biosciences, San Jose, Calif., U.S.) to detect the presence of and quantify any TCR CMV-pp65-PE STAR™ multimer bound to cells in the population (sometimes referred to herein as "staining") in relative light units (RLU).

Table 2 and FIGS. 4-8 show results from experiments using the TCR STAR™ assay detecting cell-surface complexes of C2 epitope/HLA-A2 MHC class I molecule. For each experiment, the untreated control sample was used to identify the positive and negative cell populations by employing a gate which results in less than 1% of cells from the untreated control in the "positive" gate (representing background signal). The same gate was then applied to the other samples to characterize the positive population for each sample. Positive cells in this assay were cells which were bound by the TCR-CMV-pp65-PE STAR™ reagent and counted in the positive gate described above.

In FIG. 3, the flow cytometry histogram is given with the cell counts (number of cells or simply "counts") on the Y-axis and the relative fluorescent units (RFU) representing TCR CMV-pp65 STAR™ multimer, PE staining signal on the X-axis (log scale). The black line shows the results for the untreated-cells-only sample, and the gray line shows the results for the negative controls (treatment with only a parental, cell-targeting protein lacking any viral epitope-peptide), or the treatment with a specific, exemplary, cell-targeting protein of the invention. In FIG. 3, the top panel shows the results for the untreated cell samples using a black line and the results for the cell-targeting molecule with a fused antigen, SLTA-1A-DI-FR::scFv1::C2, treated samples using a gray line. In FIG. 3, the middle panel shows the results for untreated cell samples using a black line and the results for the control protein, SLTA-1A-DI-FR::scFv1, which did not comprise any fused epitope-peptide, using a gray line. In FIG. 3, the bottom panel shows the results the results for the control protein, SLTA-1A-DI-FR::scFv1, which did not comprise any fused epitope-peptide, using a black line and the results for the cell-targeting molecule with the fused epitope, SLTA-1A-DI-FR::scFv1::C2, treated samples using a gray line.

TABLE 2

Detection of Cell Surface, MHC Class I/C2 Epitope Complexes after Delivery of C2 Epitope-Peptides by Cell-Targeting Proteins: Peptide-epitope C2/MHC class I complexes detected on the surfaces of intoxicated, target cells

| Protein | target positive cell-type | incubation duration (hours) | percentage of pMHC I complex presenting cells | iMFI (RFU) |
|---|---|---|---|---|
| Experiment 1 | | | | |
| SLT-1A-DI-FR::scFv1::C2 | Cell Line B | 16 hours | 35.0% | 10,090 |
| SLT-1A-DI-FR::scFv2 | Cell Line B | 16 hours | 4.8% | 964 |
| No protein | Cell Line B | 16 hours | 0% | 14 |

As seen in Table 2 and FIG. 3, cell samples treated with an exemplary cell-targeting protein of the present invention (SEQ ID NO:252) displayed expression of the C2-epitope/HLA-A2 MHC class I molecule complex on the surfaces of the treated cells. In contrast, cells that were treated with the parental cell-targeting protein SLT-1A-DI-FR::scFv1 (SEQ ID NO:258), which did not contain any fused T-cell epitope-peptide as a negative control, exhibited positive cell staining of less than five percent of the cells in the treated cell population (Table 2; FIG. 3). Due to processing efficiency and kinetics, which were not measured, it is possible that the percentage of presented C2-epitope/HLA-A2 complexes detected at a single time-point in a "cell-targeting protein" treatment sample may not accurately reflect the maximum quantity of C2-epitope/HLA-A2 presentation possible after delivery by a given, exemplary, cell-targeting protein of the present invention.

The detection of the T-cell epitope C2 (SEQ ID NO:21) complexed with human MHC Class I molecules (C2 epitope-peptide/HLA-A2) on the cell surface of cell-targeting molecule treated target cells demonstrated that exemplary cell-targeting protein SLTA-1A-DI-FR::scFv1::C2 (SEQ ID NO:252) comprising this fused epitope-peptide C2 (SEQ ID NO:21) and a de-immunized, furin-cleavage resistant, Shiga toxin effector polypeptide, were capable of entering target cells, performing sufficient sub-cellular routing, and delivering sufficient C2 (SEQ ID NO:21) epitope to the MHC class I pathway for surface presentation by target cells.

IV. Testing Cytotoxic T-Cell Mediated Cytolysis of Intoxicated Target Cells and Other Immune Responses Triggered by MHC Class I Presentation of T-Cell Epitopes Delivered by Cell-Targeting Molecules of the Present Invention In this Example, standard assays known in the art are used to investigate the functional consequences of target cells' MHC class I presentation of T-cell epitopes delivered by exemplary cell-targeting molecules of the invention. The functional consequences to investigate include CTL activation (e.g. signal cascade induction), CTL mediated target cell killing, and CTL cytokine release by CTLs.

A CTL-based cytotoxicity assay is used to assess the consequences of epitope presentation. The assay involves tissue-cultured target cells and T-cells. Target cells are intoxicated with exemplary cell-targeting molecules of the invention as described above in Section III. Testing Epitope-Peptide Delivery and Target Cell Surface Presentation etc. Briefly, target positive cells are incubated for twenty hours in standard conditions with different exogenously administered molecules, including a cell-targeting molecule of the invention. Next, CTLs are added to the treated target cells and incubated to allow for the CTLs to recognize and bind any target cells displaying epitope-peptide/MHC class I complexes (pMHC Is). Then certain functional consequences of pMHC I recognition are investigated using standard methods known to the skilled worker, including CTL binding to target cells, epitope-presenting target cell killing by CTL-mediated cytolysis, and the release of cytokines, such as IFN-γ or interleukins by ELISA or ELISPOT.

Assays known to the skilled worker were performed to assess functional consequences of intercellular engagement of T-cells in response to cell-surface epitope presentation by targeted cancer cells displaying epitopes delivered by exemplary cell-targeting molecules of the present invention. The results from an in vitro intercellular immune cell engagement assay show that Shiga toxin effector polypeptide-mediated delivery of a fused epitope-peptide to target positive cancer cells and subsequent cell-surface presentation of the epitope by the targeted cancer cells can result in intercellular engagement of immune cells with functional consequences, specifically IFN-γ secretion by PBMCs.

A routine assay known to the skilled worker is performed to assess intercellular T-cell activation after recognition of cell-surface epitope presentation by targeted cancer cells displaying an epitope delivered by a Shiga toxin derived cell-targeting molecule. This in vitro T-cell engagement assay shows that Shiga toxin effector polypeptide-mediated delivery of a fused epitope-peptide to target positive cancer cells and subsequent cell-surface presentation of the epitope by the targeted cancer cells can result in intercellular engagement of T-cells and intracellular cell signaling characteristic of T-cell activation.

In addition, the activation of CTLs by target cells displaying epitope-peptide/MHC class I complexes (pMHC Is) is quantified using commercially available CTL response assays, e.g. CytoTox96® non-radioactive assays (Promega, Madison, Wis., U.S.), Granzyme B ELISpot assays (Mabtech, Inc., Cincinnati, Ohio, U.S.), caspase activity assays, and LAMP-1 translocation flow cytometric assays. To specifically monitor CTL-mediated killing of target cells, carboxyfluorescein succinimidyl ester (CFSE) is used to target-cells for in vitro and in vivo investigation as described in the art (see e.g. Durward M et al., *J Vis Exp* 45 pii 2250 (2010)).

In summary, these results show that Shiga toxin effector functions, particularly subcellular routing, can be retained at high levels despite the presence of a fused epitope-peptide on the carboxy-terminus and the presence of numerous mutations in the Shiga toxin derived component providing de-immunization and protease-cleavage resistance. Furthermore, several cell-targeting molecules exhibit a level of epitope cargo delivery sufficient to produce a level of epitope-MHC class I presentation to stimulate intercellular, T-cell engagement with epitope-cargo-presenting cells.

Example 2. Cell-Targeting Molecules Comprising Shiga Toxin A Subunit Derived Polypeptides and Fused, T-Cell Epitope-Peptides Creating Cell-Targeting, Fusion Proteins Comprising Shiga Toxin A Subunit Effector Polypeptide Regions and Fused, T-Cell Epitope-Peptide Regions Cell-targeting, fusion proteins of this Example comprised a cell-targeting binding region polypeptide, a Shiga toxin A Subunit effector polypeptide, a proteinaceous linker, and a human CD8+ T-cell epitope described in WO 2015/113005, WO 2016/196344, and/or PCT/US2016/043902.

Using techniques known in the art, cell-targeting fusion proteins were created by genetically fusing a human CD8+ T-cell epitope-peptide to the amino terminus (N-terminus) or carboxy terminus (C-terminus) of a polypeptide component of a parental, cell-targeting protein comprising 1) a Shiga toxin A Subunit effector polypeptide and 2) a cell-targeting binding region polypeptide separated by a proteinaceous linker. The fused, CD8+ T-cell epitopes were chosen from among several T-cell epitope-peptides of proteins originating in viruses that commonly infect humans. Certain, cell-targeting, fusion proteins of this Example were constructed such that each comprised a single, continuous polypeptide comprising a cell-targeting, binding region polypeptide, a Shiga toxin A Subunit effector polypeptide, and a fused, heterologous, CD8+ T-cell epitope.

The exemplary cell-targeting molecules of the present invention that were produced and tested in this Example were SLT-1A-DI-1::scFv8::C2 (SEQ ID NO:256), "inactive SLT-1A-DI-4::scFv6::(C2);" (SEQ ID NO:253), and "inactive SLT-1A-DI-1::scFv8::C2" (SEQ ID NO:254). Other cell-targeting molecules that were produced and tested in this Example included: C2::SLT-1A::scFv2 (SEQ ID NO:267), "inactive C2::SLT-1A::scFv2" (SEQ ID NO:268), SLT-1A::scFv1::C2 (SEQ ID NO:278), SLT-1A::scFv2::C2 (SEQ ID NO:269), "inactive SLT-1A::scFv2::C2" (SEQ ID NO:270), F2::SLT-1A::scFv2 (SEQ ID NO:271), scFv3::F2::SLT-1A (SEQ ID NO:272), scFv4::F2::SLT-1A (SEQ ID NO:273), SLT-1A::scFv5::C2 (SEQ ID NO:274), SLT-1A::scFv6::F2 (SEQ ID NO:275), "inactive SLT-1A::scFv6::F2" (SEQ ID NO:276), SLT-1A::scFv7::C2 (SEQ ID NO:277), and C1::SLT-1A::scFv1 (SEQ ID NO:260), C1-2::SLT-1A::scFv1 (SEQ ID NO:261), C3::SLT-1A::scFv1 (SEQ ID NO:262), C24::SLT-1A::scFv1 (SEQ ID NO:263), SLT-1A::scFv1::C1 (SEQ ID NO:268), SLT-1A::scFv1::C24-2 (SEQ ID NO:264), SLT-1A::scFv1::E2 (SEQ ID NO:265), and SLT-1A::scFv1::F3 (SEQ ID NO:266). These cell-targeting, fusion proteins each comprised a cell-targeting binding region comprising a single-chain variable fragment (scFv), a Shiga toxin A Subunit effector polypeptide derived from the A Subunit of Shiga-like toxin 1 (SLT-1A), and a human CD8+ T-cell epitope-peptide fused to either the binding region or the Shiga toxin effector polypeptide.

All the Shiga toxin effector polypeptide regions of the cell-targeting molecules of this Example consisted of or were derived from amino acids 1-251 of SLT-1A (SEQ ID NO:1), and some of them contained two or more amino acid residue substitutions relative to a wild-type Shiga toxin A Subunit, such as, e.g., the catalytic domain inactivating substitution E167D, C242S, and/or substitutions resulting in furin-cleavage resistance R248A/R251A (see e.g. WO 2015/191764; WO 2016/196344). The Shiga toxin A subunit effector polypeptide component of the exemplary cell-targeting molecules of the invention of this Example include SLT-1A-DI-1 (SEQ ID NO:30), "inactive SLT-1A-DI-1" (SEQ ID NO:35), and "inactive SLT-1A-DI-4" (SEQ ID NO:38), which may be either catalytically active or modified to have reduced catalytic activity (see e.g. SEQ ID NO: 33). As used in this Example, the cell-targeting molecule nomenclature "inactive" refers to a molecule comprising only those Shiga toxin A subunit effector polypeptide component(s) that have the E167D substitution. This single amino acid residue substitution can attenuate Shiga toxin A Subunit catalytic activity, such as, e.g. by a factor 10,000-fold.

The immunoglobulin-type binding regions scFv1, scFv2, scFv3, scFv4, scFv5, scFv6, scFv7, and scFv8 are each single-chain variable fragments that bound with high-affinity to a certain cell-surface, target biomolecule physically coupled to the surface of certain human cancer cells. Both scFv1 and scFv2 bind with high affinity and specificity to the same extracellular target biomolecule. Both scFv3 and scFv5 bind with high affinity and specificity to the same extracellular target biomolecule. All three of scFv6, scFv7, and scFv8 bind with high affinity and specificity to the same extracellular target biomolecule. None of scFv1, scFv3, scFv4, and scFv6 target the same extracellular target biomolecule.

All of the cell-targeting molecules tested in the experiments of this Example, including reference cell-targeting molecules, were produced in a bacterial system and purified by column chromatography using techniques known to the skilled worker.

Testing the Shiga Toxin A Subunit Effector Polypeptide Components of Cell-Targeting Molecules for Retention of Shiga Toxin Functions after the Fusion of Binding Regions and T-Cell Epitope-Peptides Cell-targeting proteins were tested for retention of Shiga toxin A Subunit effector functions after the fusion of heterologous, CD8+ T-cell epitope-peptides. The Shiga toxin A Subunit effector functions analyzed were: catalytic inactivation of eukaryotic ribosomes, cytotoxicity, and by inference self-directing subcellular routing to the cytosol. At least seven, cell-targeting proteins exhibited catalytic activity comparable to a wild-type, Shiga toxin effector polypeptide not fused to any heterologous, T-cell epitope-peptide or additional polypeptide moiety.

1. Testing the Ribosome Inhibition Ability of Cell-Targeting Molecules of the Invention The catalytic activities of Shiga toxin A Subunit derived Shiga toxin effector polypeptide regions of cell-targeting molecules were tested using a ribosome inhibition assay.

The ribosome inactivation capabilities of cell-targeting proteins of this Example were determined using a cell-free, in vitro protein translation assay using the TNT® Quick Coupled Transcription/Translation Kit (L1170 Promega Madison, Wis., U.S.). The kit includes Luciferase T7 Control DNA (L4821 Promega Madison, Wis., U.S.) and TNT® Quick Master Mix. The ribosome activity reaction was prepared according to manufacturer's instructions. A series of 10-fold dilutions of the Shiga toxin derived, cell-targeting protein to be tested was prepared in an appropriate buffer and a series of identical TNT reaction mixture components were created for each dilution. Each sample in the dilution series was combined with each of the TNT reaction mixtures along with the Luciferase T7 Control DNA. The test samples were incubated for 1.5 hours at 30 degrees Celsius (° C.). After the incubation, Luciferase Assay Reagent (E1483 Promega, Madison, Wis., U.S.) was added to all test samples and the amount of luciferase protein translation was measured by luminescence according to manufacturer's instructions.

The level of translational inhibition was determined by non-linear regression analysis of log-transformed concentrations of total protein versus relative luminescence units. Using statistical software (GraphPad Prism, San Diego, Calif., U.S.), the half maximal inhibitory concentration ($IC_{50}$) value was calculated for each sample using the Prism software function of log(inhibitor) vs. response (three parameters) [Y=Bottom+((Top−Bottom)/(1+10^(X−Log $IC_{50}$)))] under the heading dose-response-inhibition. The $IC_{50}$ values for each Shiga toxin derived, cell-targeting protein from one or more experiments was calculated and is shown in Table 3 in picomolar (pM). Any cell-targeting molecule which exhibited an $IC_{50}$ within 10-fold of a positive control molecule comprising a wild-type, Shiga toxin effector polypeptide (e.g. SLT-1A-WT (SEQ ID NO:279)) is considered herein to exhibit ribosome inhibition activity comparable to wild-type.

TABLE 3

Ribosomal Inhibition by Shiga Toxin Derived, Cell-Targeting Proteins Fused to Heterologous Epitope-Peptides

| Protein | fused epitope | fusion location | ribosomal inhibition $IC_{50}$ (pM) |
|---|---|---|---|
| Experiment 1 | | | |
| C1::SLT-1A::scFv1 | C1 | N-terminal fusion | 3.2 |
| C1-2::SLT-1A::scFv1 | C1-2 | N-terminal fusion | 1.2 |
| C3::SLT-1A::scFv1 | C3 | N-terminal fusion | 5.6 |
| C24::SLT-1A::scFv1 | C24 | N-terminal fusion | 1.4 |
| SLT-1A::scFv1 | | none; control molecule having no fused epitope | 1.2 |
| Experiment 2 | | | |
| C2::SLT-1A::scFv2 | C2 | N-terminal fusion | 12.6 |
| SLT-1A::scFv2::C2 | C2 | C-terminal fusion | 13.1 |
| SLT-1A::scFv2 | | none; control molecule having no fused epitope | 8.3 |
| Experiment 3 | | | |
| F2::SLT-1A::scFv2 | F2 | N-terminal fusion | 2.2 |
| SLT-1A::scFv2 | | none; control molecule having no fused epitope | 8.2 |
| Experiment 4 | | | |
| scFv3::F2::SLT-1A | F2 | between binding region and Shiga toxin effector (N-terminal of Shiga toxin effector) | 6.0 |
| sc.Fv4::F2::SLT-1A | F2 | between binding region and Shiga toxin effector (N-terminal of Shiga toxin effector) | 5.0 |
| SLT-1A-WT only | | none; control molecule having no fused epitope | 9.8 |
| Experiment 5 | | | |
| SLT-1A::scFv5::C2 | C2 | C-terminal fusion | 1.0 |
| SLT-1A::scFv5 | | none; control molecule having no fused epitope | 2.1 |

TABLE 3-continued

Ribosomal Inhibition by Shiga Toxin Derived, Cell-Targeting
Proteins Fused to Heterologous Epitope-Peptides

| Protein | fused epitope | fusion location | ribosomal inhibition $IC_{50}$ (pM) |
|---|---|---|---|
| Experiment 6 | | | |
| SLT-1A::scFv6::F2 | F2 | C-terminal fusion | 5.6 |
| SLT-1A::scFv6 | | none; control molecule having no fused epitope | 3.2 |
| SLT-1A-WT only | | none; control molecule having no fused epitope | 6.1 |

As shown in Table 3, cell-targeting proteins exhibited potent ribosome inhibition comparable to the positive controls: 1) a "SLT-1A-WT only" polypeptide (SEQ ID NO:279) comprising only a wild-type Shiga toxin A Subunit polypeptide sequence and 2) a cell-targeting protein comprising a SLT-1A derived Shiga toxin effector polypeptide fused to a scFv binding region but lacking any fused, heterologous, CD8+ T-cell epitope-peptide, e.g., SLT-1A::scFv1 (SEQ ID NO:280), SLT-1A::scFv2 (SEQ ID NO:281), SLT-1A::scFv5 (SEQ ID NO:283), or SLT-1A::scFv6 (SEQ ID NO:284).

2. Testing the Cytotoxic Activities of Cell-Targeting Molecules of the Invention The cytotoxic activities of cell-targeting molecules were measured using a tissue culture cell-based toxicity assay. The concentration of exogenously administered cell-targeting molecule which kills half the cells in a homogenous cell population (half-maximal cytotoxic concentration) was determined for certain cell-targeting molecules. The cytotoxicities of cell-targeting molecules were tested using cell-kill assays involving either target biomolecule positive or target biomolecule negative cells with respect to the target biomolecule of each cell-targeting molecule's binding region.

The cell-kill assays were performed as follows. Human tumor cell line cells were plated (typically at $2\times10^3$ cells per well for adherent cells, plated the day prior to protein addition, or $7.5\times10^3$ cells per well for suspension cells, plated the same day as protein addition) in 20 μL cell culture medium in 384-well plates. A series of 10-fold dilutions of the proteins to be tested was prepared in an appropriate buffer, and 5 μL of the dilutions or only buffer as a negative control were added to the cells. Control wells containing only cell culture medium were used for baseline correction. The cell samples were incubated with the proteins or just buffer for 3 or 5 days at 37° C. and in an atmosphere of 5% carbon dioxide ($CO_2$). The total cell survival or percent viability was determined using a luminescent readout using the CellTiter-Glo® Luminescent Cell Viability Assay (G7573 Promega Madison, Wis., U.S.) according to the manufacturer's instructions as measured in relative light units (RLU).

The Percent Viability of experimental wells was calculated using the following equation: (Test RLU−Average Media RLU)/(Average Cells RLU−Average Media RLU) *100. Log protein concentration versus Percent Viability was plotted in Prism (GraphPad Prism, San Diego, Calif., U.S.) and log (inhibitor) versus response (3 parameter) analysis were used to determine the half-maximal cytotoxic concentration ($CD_{50}$) value for the tested proteins. The $CD_{50}$ values for each cell-targeting protein tested was calculated when possible.

The specificity of the cytotoxic activity of a given cell-targeting molecule was determined by comparing cell kill activities toward cells expressing a significant amount of a target biomolecule of the binding region of the cell-targeting molecule (target positive cells) with cell-kill activities toward cells which do not exhibit any significant amount of any target biomolecule of the binding region of the cell-targeting molecule physically coupled to any cellular surface (target negative cells). This was accomplished by determining the half-maximal cytotoxic concentrations of a given cell-targeting molecule toward cell populations which were positive for cell surface expression of the target biomolecule of the cell-targeting molecule being analyzed, and, then, using the same cell-targeting molecule concentration range to attempt to determine the half-maximal cytotoxic concentrations toward cell populations which were negative for cell surface expression of the target biomolecule of the cell-targeting molecule. In some experiments, the target negative cells treated with the maximum amount of the Shia-toxin containing molecule did not show any change in viability as compared to a "buffer only" negative control.

The cytotoxic activity levels of various molecules tested using the cell-kill assay described above are reported in Table 4. As reported in Table 4, cell targeting proteins which were tested in this assay exhibited potent cytotoxicity. While the fusion of a heterologous, CD8+ T-cell epitope-peptide to a Shiga toxin derived, cell-targeting protein can result in no change in cytotoxicity, some cell-targeting proteins exhibited reduced cytotoxicity as compared to the parental protein from which it was derived, which did not comprise any fused, heterologous epitope-peptide (Table 4). As reported in the Examples, a molecule exhibiting a $CD_{50}$ value within 10-fold of a $CD_{50}$ value measured for a reference molecule is considered to exhibit cytotoxic activity comparable to that reference molecule. In particular, any cell-targeting molecule that exhibited a $CD_{50}$ value to a target positive cell population within 10-fold of the $CD_{50}$ value of a reference cell-targeting molecule comprising the same binding region and a wild-type, Shiga toxin effector polypeptide (e.g. SLT-1A-WT (SEQ ID NO:279)) but not comprising any fused, heterologous, T-cell epitope-peptide, toward the same cell-type is referred to herein as "comparable to wild-type." Cell-targeting molecules that exhibited a $CD_{50}$ value to a target positive cell population within 100-fold to 10-fold of a reference molecule comprising the same binding region and the same Shiga toxin effector polypeptide but not comprising any fused, heterologous, T-cell epitope-peptide is referred to herein as active but "attenuated."

TABLE 4

Cytotoxic Activities of Shiga Toxin Derived, Cell-Targeting Proteins Comprising Fused, Heterologous Epitope-Peptides

| Protein | fused epitope | fusion location | cell-type in assay | Cytotoxicity $CD_{50}$ (nM) |
|---|---|---|---|---|
| Experiment 1 | | | | |
| C1::SLT-1A::scFv1 | C1 | N-terminus | Cell Line A (target positive) | 0.025 |
| C1-2::SLT-1A::scFv1 | C1-2 | N-terminus | Cell Line A (target positive) | 0.067 |
| C3::SLT-1A::scFv1 | C3 | N-terminus | Cell Line A (target positive) | 0.059 |
| C24::SLT-1A::scFv1 | C24 | N-terminus | Cell Line A (target positive) | 0.240 |
| SLT-1A::scFv1 | none; control molecule having no fused epitope | | Cell Line A (target positive) | 0.010 |
| SLT-1A-WT only | none; control molecule having no fused epitope | | Cell Line A (target positive) | >100 nM |
| Experiment 2 | | | | |
| SLT-1A::scFv1::C1 | C1 | C-terminus | Cell Line A (target positive) | 0.009 |
| SLT-1A::scFv1::C24-2 | C24-2 | C-terminus | Cell Line A (target positive) | 0.263 |
| SLT-1A::scFv1::F3 | F3 | C-terminus | Cell Line A (target positive) | 0.041 |
| SLT-1A::scFv1::E2 | E2 | C-terminus | Cell Line A (target positive) | 0.213 |
| SLT-1A::scFv1 | none; control molecule having no fused epitope | | Cell Line A (target positive) | 0.004 |
| Experiment 3 | | | | |
| SLT-1A::scFv1::C2 | C2 | C-terminus | Cell Line B (target positive) | 0.041 |
| SLT-1A::scFv1 | none; control molecule having no fused epitope | | Cell Line B (target positive) | 0.097 |
| SLT-1A-WT only | none; control molecule having no fused epitope | | Cell Line B (target positive) | >100 nM |
| SLT-1A::scFv1::C2 | C2 | C-terminus | Cell Line C (target negative) | >100 nM |
| SLT-1A::scFv1 | none; control molecule having no fused epitope | | Cell Line C (target negative) | >100 nM |
| SLT-1A-WT only | none; control molecule having no fused epitope | | Cell Line C (target negative) | >100 nM |
| Experiment 4 | | | | |
| F2::SLT-1A::scFv2 | F2 | N-terminus | Cell Line A (target positive) | 0.016 |
| SLT-1A::scFv2 | none; control molecule having no fused epitope | | Cell Line A (target positive) | 0.016 |
| SLT-1A-WT only | none; control molecule having no fused epitope | | Cell Line A (target positive) | 33.000 |
| F2::SLT-1A::scFv2 | F2 | N-terminus | Cell Line B (target positive) | 0.0140 |
| SLT-1A::scFv2 | none; control molecule having no fused epitope | | Cell Line B (target positive) | 0.0250 |
| SLT-1A-WT only | none; control molecule having no fused epitope | | Cell Line B (target positive) | 310.000 |
| Experiment 5 | | | | |
| C2::SLT-1A::scFv2 | C2 | N-terminus | Cell Line B (target positive) | 0.35 |
| SLT-1A::scFv2::C2 | C2 | C-terminus | Cell Line B (target positive) | 0.31 |
| inactive C2::SLT-1A::scFv2 | C2 | N-terminus | Cell Line B (target positive) | >100 nM |
| SLT-1A::scFv2::C2 | none; control molecule having no fused epitope | | Cell Line B (target positive) | 0.11 |
| SLT-1A-WT only | none; control molecule having no fused epitope | | Cell Line B (target positive) | >100 nM |
| Experiment 6 | | | | |
| scFv3::F2::SLT-1A | F2 | between binding region and Shiga toxin effector (N-terminal of Shiga toxin effector) | Cell Line D (target positive) | 1.42 |

TABLE 4-continued

Cytotoxic Activities of Shiga Toxin Derived, Cell-Targeting Proteins Comprising Fused, Heterologous Epitope-Peptides

| Protein | fused epitope | fusion location | cell-type in assay | Cytotoxicity $CD_{50}$ (nM) |
|---|---|---|---|---|
| scFv3::SLT-1A | none; | control molecule having no fused epitope | Cell Line D (target positive) | 1.35 |
| SLT-1A-WT only | none; | control molecule having no fused epitope | Cell Line D (target positive) | >100 nM |
| | | Experiment 7 | | |
| SLT-1A::scFv5::C2 | C2 | C-terminus | Cell Line E (target positive) | 0.33 |
| SLT-1A::scFv5 | none; | control molecule having no fused epitope | Cell Line E (target positive) | 0.25 |
| SLT-1A-WT | none; | control molecule having no fused epitope | Cell Line E (target positive) | >100 nM |
| | | Experiment 8 | | |
| SLT-1A::scFv6::F2 | F2 | C-terminus | Cell Line F (target positive) | 0.061 |
| SLT-1A::scFv6 | none; | control molecule having no fused epitope | Cell Line F (target positive) | 0.142 |
| SLT-1A::scFv7::C2 | C2 | C-terminus | Cell Line F (target positive) | 0.011 |
| SLT-1A::scFv7 | none; | control molecule having no fused epitope | Cell Line F (target positive) | 0.018 |

All the tested, cell-targeting proteins potently killed target positive cells (Table 4) but did not kill comparable percentages of target negative cells at the same dosages (see e.g. FIGS. 6 and 7). FIGS. 6 and 7 graphically show the specific cytotoxicity of the cell-targeting protein SLT-1A::scFv1::C2 (SEQ ID NO:278) was only specific to target expressing cells (FIG. 6) but not target negative cells over the concentration range tested (FIG. 7). The $CD_{50}$ values of cell-targeting proteins toward target negative cells could not be calculated from the concentration range of cell-targeting protein tested because an accurate curve could not be generated when there was not a sizeable decrease in cell viability at the highest tested concentrations (see e.g. FIG. 7).

Testing Epitope-Peptide Delivery and Target Cell Surface Presentation of Delivered Epitope-Peptides The successful delivery of a T-cell epitope can be determined by detecting specific cell surface, MHC class T molecule/epitope complexes (pMHC Is). In order to test whether a cell-targeting protein can deliver a fused T-cell epitope to the MHC class I presentation pathway of target cells, an assay was employed which detects human, MHC Class I molecules complexed with specific epitopes. A flow cytometry method was used to demonstrate delivery of a T-cell epitope (fused to a Shiga toxin A Subunit derived cell-targeting protein) and extracellular display of the delivered T-cell epitope-peptide in complex with MHC Class I molecules on the surfaces of target cells. This flow cytometry method utilizes soluble human T-cell receptor (TCR) multimer reagents (Soluble T-Cell Antigen Receptor STAR™ Multimer, Altor Bioscience Corp., Miramar, Fla., U.S.), each with high-affinity binding to a different epitope-human HLA complex.

Each STAR™ TCR multimer reagent is derived from a specific T-cell receptor and allows detection of a specific peptide-MHC complex based on the ability of the chosen TCR to recognize a specific peptide presented in the context of a particular MHC class I molecule. These TCR multimers are composed of recombinant human TCRs which have been biotinylated and multimerized with streptavidin. The TCR multimers are labeled with phycoerythrin (PE). These TCR multimer reagents allow the detection of specific peptide-MHC Class I complexes presented on the surfaces of human cells because each soluble TCR multimer type recognizes and stably binds to a specific peptide-MHC complex under varied conditions (Zhu X et al., *J Immunol* 176: 3223-32 (2006)). These TCR multimer reagents allow the identification and quantitation by flow cytometry of peptide-MHC class I complexes present on the surfaces of cells.

The TCR CMV-pp65-PE STAR™ multimer reagent (Altor Bioscience Corp., Miramar, Fla., U.S.) was used in this Example. MHC class I pathway presentation of the human CMV C2 peptide (NLVPMVATV (SEQ ID NO:21)) by human cells expressing the HLA-A2 can be detected with the TCR CMV-pp65-PE STAR™ multimer reagent which exhibits high affinity recognition of the CMV-pp65 epitope-peptide (residues 495-503, NLVPMVATV) complexed to human HLA-A2 and is labeled with PE.

The target cells used in this Example (target positive cell lines B, D, E, F, G, H, I, J, and K) were immortalized human cancer cells available from the ATCC (Manassas Va., U.S.) or the DSMZ (The Leibniz Deutsche Sammlung von Mikroorganismen und Zellkulture) (Braunschweig, Del.)). Using standard flow cytometry methods known in the art, the target cells were confirmed to express on their cell surfaces both the HLA-A2 MHC-Class T molecule and the extracellular target biomolecules of the cell-targeting proteins used in this Example. In some experiments, the human cancer cells were pretreated with human interferon gamma (IFN-γ) to enhance expression of human HLA-A2.

Sets of target cells were treated by exogenous administration of cell-targeting molecules comprising a carboxy-terminal fused, viral, CD8+ T-cell epitope: SLT-1A::scFv1::C2 (SEQ ID NO:278), "inactive SLT-1A::scFv2::C2" (SEQ ID NO:270), SLT-1A::scFv5::C2 (SEQ ID NO:273), and SLT-1A::scFv7::C2 (SEQ ID NO:277); or were treated by exogenous administration of a negative-control cell-targeting fusion protein which did not comprise any fused, heterologous, viral epitope-peptide (SLT-1A::scFv1 (SEQ ID N0280), SLT-1A::scFv2 (SEQ ID NO:282), "inactive SLT- 1A::scFv2" (SEQ ID NO:281), SLT-1A::scFv5 (SEQ ID NO:283), or SLT-1A::scFv7 (SEQ ID NO:286)). The cell-targeting molecules and reference molecules used in these experiments include both catalytically active, cytotoxic cell-targeting molecules and "inactive" cell-targeting molecules—meaning all their Shiga toxin effector polypeptide components comprised the mutation E167D which severely reduces the catalytic activity of Shiga toxin A Subunits and Shiga toxins. These treatments were at cell-targeting molecule concentrations similar to those used by others taking into account cell-type specific sensitivities to Shiga toxins (see e.g. WO 2015/113005). The treated cells were then incubated for 4-16 hours in standard conditions, including at 37° C. and an atmosphere with 5% carbon dioxide, to allow for intoxication mediated by a Shiga toxin effector polypeptide. Then the cells were washed and incubated with the TCR CMV-pp65-PE STAR™ multimer reagent to "stain" C2 peptide-HLA-A2 complex-presenting cells.

As controls, sets of target cells were treated in three conditions: 1) without any treatment ("untreated") meaning there was addition of only buffer to the cells and no addition of any exogenous molecules, 2) with exogenously administered CMV C2 peptide (CMV-pp65, aa495-503: sequence NLVPMVATV (SEQ ID NO:21), synthesized by BioSynthesis, Lewisville, Tex., U.S.), and/or 3) with exogenously administered CMV C2 peptide ((SEQ ID NO:21), as above) combined with a Peptide Loading Enhancer ("PLE," Altor Biosicence Corp., Miramar, Fla., U.S.). The C2 peptide (SEQ ID NO:21) combined with PLE treatment allowed for exogenous peptide loading and served as a positive control. Cells displaying the appropriate MHC class I haplotype can be forced to load the appropriate exogenously applied peptide from an extracellular space (i.e. in the absence of cellular internalization of the applied peptide) or in the presence of PLE, which is a mixture of B2-microglobulin and other components.

After the treatments, all the sets of cells were washed and incubated with the TCR CMV-pp65-PE STAR™ multimer reagent for one hour on ice. The cells were washed and the fluorescence of the samples was measured by flow cytometry using an Accuri™ C6 flow cytometer (BD Biosciences, San Jose, Calif., U.S.) to detect the presence of and quantify any TCR CMV-pp65-PE STAR™ multimer bound to cells in the population (sometimes referred to herein as "staining") in relative light units (RLU).

Table 5 and FIGS. 8-12 show results from experiments using the TCR STAR™ assay detecting cell-surface complexes of C2 epitope/HLA-A2 MHC class I molecule. For each experiment, the untreated control sample was used to identify the positive and negative cell populations by employing a gate which results in less than 1% of cells from the untreated control in the "positive" gate (representing background signal). The same gate was then applied to the other samples to characterize the positive population for each sample. Positive cells in this assay were cells which were bound by the TCR-CMV-pp65-PE STAR™ reagent and counted in the positive gate described above. In FIG. 8 and FIGS. 10-12, the flow cytometry histograms are given with the counts (number of cells) on the Y-axis and the relative fluorescent units (RFU) representing TCR CMV-pp65 STAR™ multimer, PE staining signal on the X-axis (log scale). The black line shows the results for the untreated-cells-only sample, and the gray line shows the results for the negative controls (treatment with only a parental, cell-targeting protein lacking any viral epitope-peptide), or the treatment with a specific, cell-targeting protein. In FIGS. 8, 11, and 12, the top panels show the results for the untreated cell samples using black lines and the results for the cell-targeting molecule treated samples using gray lines. In FIGS. 8, 11, and 12, the bottom panels show the results for untreated cell samples using black lines and the results for the control proteins, which did not comprise any fused epitope-peptide, using gray lines. In FIG. 10, the top panel shows the results from a 4-hour incubation and the bottom panel shows the results for a 16-hour incubation. In Table 5, the percentage of cells in a treatment set which stained positive for the C2-epitope-peptide-HLA-A2 MHC class I molecule complex is given Table 5 also shows the corresponding indexed, mean, fluorescent intensity ("iMFI," the fluorescence of the positive population multiplied by the percent positive) in RFU for each treatment set.

TABLE 5

Detection of Cell Surface, MHC Class I/C2 Epitope Complexes after Delivery of C2 Epitope-Peptides by Cell-Targeting Proteins: Peptide-epitope C2/MHC class I complexes detected on the surfaces of intoxicated, target cells

| Protein | target positive cell-type | incubation duration (hours) | percentage of pMHC I complex presenting cells | iMFI (RFU) |
|---|---|---|---|---|
| Experiment 1 | | | | |
| SLT-1A::scFv1::C2 | Cell Line B | 4 hours | 33.0% | 440 |
| SLT-1A::scFv2 | Cell Line B | 4 hours | 5.0% | 80 |
| Experiment 2 | | | | |
| SLT-1A::scFv1::C2 | Cell Line B | 16 hours | 95.4% | 28,800 |
| SLT-1A::scFv1 | Cell Line B | 16 hours | 5.0% | 154 |
| Experiment 3 | | | | |
| inactive SLT-1A::scFv2::C2 | Cell Line G | 24 hours | 43.3% | 4,034 |
| inactive SLT-1A::scFv2 | Cell Line G | 24 hours | 0.2% | 17 |
| C2 peptide | Cell Line G | 24 hours | 57.8% | 5,114 |
| C2 peptide + PLE | Cell Line G | 24 hours | 0.5% | 79 |
| Experiment 4 | | | | |
| inactive SLT-1A::scFv2::C2 | Cell Line B | 16 hours | 80.5% | 3,170 |
| inactive SLT-1A::scFv2 | Cell Line B | 16 hours | 4.1% | 63 |
| inactive SLT-1A::scFv2::C2 | Cell Line H | 16 hours | 67.9% | 2,550 |
| inactive SLT-1A::scFv2 | Cell Line H | 16 hours | 3.5% | 47 |

TABLE 5-continued

Detection of Cell Surface, MHC Class I/C2 Epitope Complexes after Delivery of C2 Epitope-Peptides by Cell-Targeting Proteins: Peptide-epitope C2/MHC class I complexes detected on the surfaces of intoxicated, target cells

| Protein | target positive cell-type | incubation duration (hours) | percentage of pMHC I complex presenting cells | iMFI (RFU) |
|---|---|---|---|---|
| Experiment 5 | | | | |
| SLT-1A::scFv5::C2 | Cell Line E | 24 hours | 41.9% | 17,846 |
| SLT-1A::scFv5 | Cell Line E | 24 hours | 0.5% | 64 |
| C2 peptide | Cell Line E | 24 hours | 2.4% | 357 |
| C2 peptide + PLE | Cell Line E | 24 hours | 93.2% | 42,429 |
| Experiment 6 | | | | |
| SLT-1A::scFv7::C2 | Cell Line F | 16 hours | 27.6% | 6,132 |
| SLT-1A::scFv7 | Cell Line F | 16 hours | 1.7% | 365 |

As seen in Table 5 and FIGS. 8-12, cell samples treated with exemplary cell-targeting proteins displayed expression of the C2-epitope/HLA-A2 MH-C class I molecule complex on the surfaces of a majority of the treated cells depending on the incubation duration. Cells treated with the exogenous cell-targeting proteins SLT-1A::scFv1::C2 (SEQ ID NO:278) or "inactive SLT-1A::scFv2::C2" (SEQ ID NO:270), SLT-1A::scFv5::C2 (SEQ ID NO:274), and SLT-1A::scFv7::C2 (SEQ ID NO:277) showed a positive signal for cell-surface, C2-epitope/HLA-A2 complexes on 33-95% of the cells in the samples analyzed (Table 5). In contrast, cells that were treated with parental cell-targeting proteins, which did not contain any fused T-cell epitope-peptide as a negative control, exhibited positive cell staining of five percent or less of the cells in the treated cell population (Table 5; FIGS. 8-12).

While the majority of cells treated with cell-targeting proteins of this Example displayed on a cell surface the C2-epitope/HLA-A2 complex, five percent or less of the cells in "untreated" cell populations displayed TCR STAR™ staining for C2-epitope/HLA-A2 complexes (Table 5; FIG. 8; FIG. 10). The positive control treatment showed robust staining of 99% of the cells in the population due exclusively to loading of only exogenous C2 epitope-peptide (SEQ ID NO:21) in the presence of the peptide loading enhancer (FIG. 9). Due to processing efficiency and kinetics, which were not measured, it is possible that the percentage of presented C2-epitope/HLA-A2 complexes detected at a single time-point in a "cell-targeting protein" treatment sample may not accurately reflect the maximum quantity of C2-epitope/HLA-A2 presentation possible after delivery by a given cell-targeting protein.

The detection of the T-cell epitope C2 (SEQ ID NO:21) complexed with human MHC Class I molecules (C2 epitope-peptide/HLA-A2) on the cell surface of cell-targeting molecule treated target cells demonstrated that cell-targeting proteins (SLT-1A::scFv1::C2 (SEQ ID NO:278), "inactive SLT-1A::scFv2::C2" (SEQ ID NO:270), SLT-1A::scFv5::C2 (SEQ ID NO:274), and SLT-1A::scFv7::C2 (SEQ ID NO:277)) comprising this fused epitope-peptide (C2 (SEQ ID NO:21)) were capable of entering target cells, performing sufficient sub-cellular routing, and delivering sufficient C2 (SEQ ID NO:21) epitope to the MHC class I pathway for surface presentation by target cell surface.

Testing Cytotoxic T-Cell Mediated Cytolysis of Intoxicated Target Cells and Other Immune Responses Triggered by MHC Class I Presentation of T-Cell Epitopes Delivered by Cell-Targeting Molecules of the Present Invention In this Example, standard assays known in the art are used to investigate the functional consequences of target cells' MHC class I presentation of T-cell epitopes delivered by exemplary cell-targeting molecules. The functional consequences to investigate include CTL activation (e.g. signal cascade induction), CTL mediated target cell killing, and CTL cytokine release by CTLs.

A CTL-based cytotoxicity assay is used to assess the consequences of epitope presentation. The assay involves tissue-cultured target cells and T-cells. Target cells are intoxicated with exemplary cell-targeting molecules as described above in this Example in the sub-section "Testing Epitope-Peptide Delivery and Target Cell Surface Presentation" etc. Briefly, target positive cells are incubated for twenty hours in standard conditions with different exogenously administered molecules, including a cell-targeting molecule. Next, CTLs are added to the treated target cells and incubated to allow for the CTLs to recognize and bind any target cells displaying epitope-peptide/MHC class I complexes (pMHC Is). Then certain functional consequences of pMHC I recognition are investigated using standard methods known to the skilled worker, including CTL binding to target cells, epitope-presenting target cell killing by CTL-mediated cytolysis, and the release of cytokines, such as IFN-γ or interleukins by ELISA or ELISPOT.

Assays were performed to assess functional consequences of intercellular engagement of T-cells in response to cell-surface epitope presentation by targeted cancer cells displaying epitopes delivered by cell-targeting molecules.

FIG. 13 and Table 6 show the results of an Interferon Gamma ELIspot assay (Mabtech, Inc., Cincinnati, Ohio, U.S.) used according to manufacturer's instructions. This ELISPOT assay can be used to quantify IFN-γ secretion as each spot indicates a IFN-γ secreting cell. Briefly, samples of cells of target positive cell line G were incubated for 20 hours with either just phosphate buffered saline (PBS) buffer ("buffer only"), "inactive SLT-1A::scFv2::C2" (SEQ ID NO:270), or the reference molecule "inactive SLT-1A::scFv2" (SEQ ID NO:282). The samples were washed with PBS and added to ELISPOT plates already loaded with human PBMCs (HLA-A2 serotype) from Cellular Technology Limited (Shaker Heights, Ohio, U.S.). The plates were incubated for an additional 24 hours, and then spots were detected according to the Interferon Gamma ELIspot assay Mabtech kit instructions and quantified using an ELISPOT plate reader (Zellnet Consulting, Inc., Fort Lee, N.J., U.S.).

TABLE 6

Interferon Gamma Secretion by PBMCs after Recognizing Epitope Presentation by Target Cells Incubated with "inactive SLTA-1A::scFv2::C2"

| Protein | target positive cell-type | Average number of spots | Average Area per spot |
|---|---|---|---|
| inactive SLT-1A::scFv2::C2 | Cell Line G | 490 | 2,636,291 |
| inactive SLT-1A::scFv2 | Cell Line G | 280 | 1,511,726 |
| buffer only | Cell Line G | 334 | 2,144,217 |

The results in Table 6 and FIG. 13 show that the incubation of cell line G cells with the cell-targeting molecule "inactive SLT-1A::scFv2::C2" (SEQ ID NO:270) resulted in a PBMC luciferase activity signal greater than the background signal determined using the buffer only treated cell sample or the luciferase signal from the sample cells treated with the reference molecule "inactive SLT-1A::scFv2" (SEQ ID NO:282). The results from this in vitro intercellular immune cell engagement assay showed that Shiga toxin effector polypeptide-mediated delivery of a fused epitope-peptide to target positive cancer cells and subsequent cell-surface presentation of the epitope by the targeted cancer cells can result in intercellular engagement of immune cells with functional consequences, specifically IFN-γ secretion by PBMCs.

When an effector T-cell recognizes a specific epitope-MHC-I complex, the T-cell may initiate an intracellular signaling cascade that drives the translocation of nuclear factor of activated T-cells (NFAT) transcription factors from the cytosol into the nucleus and can result in the stimulation of the expression of genes that contain a NFAT response element(s) (RE) (see e.g. Macian F, *Nat Rev Immunol* 5: 472-84 (2005)). A J76 T-cell line engineered to express a human T-cell receptor that specifically recognizes the F2 peptide/human HLA A2 MHC class I molecule complex (Berdien B et al., *Hum Vaccin Immunother* 9: 1205-16 (2013)) was transfected with a luciferase expression vector (pGL4.30[luc2P/NFAT-RE/Hygro], CAT #E8481, Promega Corp., Madison, Wis., U.S.) that is regulated by an NFAT-RE. When the luciferase-reporter-transfected J76 TCR specific cell recognizes a cell displaying the HLA-A2/F2 epitope-peptide (SEQ ID NO:25) complex, then expression of luciferase can be stimulated by NFAT transcription factors binding to the NFAT-RE of the expression vector. Luciferase activity levels in the transfected J76 cells can be quantified by the addition of a standard luciferase substrate and then reading luminescence levels using a photodetector.

An assay was performed to assess intercellular T-cell activation after recognition of cell-surface epitope presentation by targeted cancer cells displaying an epitope delivered by a cell-targeting molecule. Briefly, cells samples of cell line F were incubated with "inactive SLT-1A::scFv6::F2" (SEQ ID NO:276), the reference molecule "inactive SLT-1A::scFv6" (SEQ ID NO:285), or just buffer alone for 6 hours, and then washed. Then, luciferase-reporter-transfected J76 T-cells were mixed with each sample, and the mixtures of cells were incubated for 18 hours. Next, luciferase activity was measured using the One-Glo™ Luciferase Assay System reagent (Promega Corp., Madison, Wis., U.S.). FIG. 14 and Table 7 shows the results from this intercellular T-cell engagement assay.

TABLE 7

Luciferase Signal Driven by the NFAT Response Element in Reporter Cells after Recognition of Epitope Presentation by Target Cells Incubated with "inactive SLTA-1A::scFv6::F2"

| Protein | target positive cell-type | Average Luciferase Signal (RLU) |
|---|---|---|
| inactive SLT-1A::scFv6::F2 | Cell Line F | 565 |
| inactive SLT-1A::scFv6 | Cell Line F | 259 |
| buffer only | Cell Line F | 242 |

The results in Table 7 and FIG. 14 show that incubation with the cell-targeting molecule "inactive SLT-1A::scFv6::F2" (SEQ ID NO:276) resulted in luciferase activity levels greater than the background luciferase activity signal determined using "buffer only" treated cells or the luciferase activity from cell samples treated with the negative control molecule "inactive SLT-1A::scFv6" (SEQ ID NO:285). This in vitro T-cell engagement assay showed that Shiga toxin effector polypeptide-mediated delivery of a fused epitope-peptide to target positive cancer cells and subsequent cell-surface presentation of the epitope by the targeted cancer cells can result in intercellular engagement of T-cells and an intracellular cell signaling readout characteristic of T-cell activation.

When an effector T-cell recognizes a specific epitope-MHC-I complex, the T-cell may initiate an intracellular signaling cascade that promotes effector cytokine (e.g. IFN-γ) secretion and/or results in in intercellular, immune cell-mediated killing of the cell presenting that specific epitope MHC-1 complex. An assay was performed to assess T-cell secretion of IFN-γ and CD8+ T-cell-mediated cytotoxicity after recognition of cell-surface epitope presentation by targeted cancer cells displaying an epitope delivered by a cell-targeting molecule. This assay involves the coincubation of tumor cells, which were pretreated with a cell-targeting molecule of the present invention, with peripheral blood mononuclear cells (PBMCs), including T-cells capable of recognizing a specific pMHC I, i.e. T-cells expressing a T-cell receptor that specifically recognizes the peptide-MHC class I molecule complex on the surface of another presenting cell.

The coincubation intercellular T-cell assay was performed as follows to measure IFN-γ secretion and target cell killing. Cells of cell line I, which is target positive for the extracellular molecule bound by scFv6, were incubated for four hours with either 500 nM of "inactive SLT-1A-DI-4::scFv6::(C2)$_3$" (SEQ ID NO:253) or PBS alone ("buffer only") at 37° C. and in an atmosphere of five percent $CO_2$. Then the cells were washed and combined with media containing PBMCs which are HLA-A02/C2 seropositive. Prior to coculture, the PBMCs were enriched for C2-restricted T-cells by one to two weeks of culture-expansion in the presence of the C2 peptide (SEQ ID NO:21) to obtain a frequency of about one to five percent C2-reactive T-cells (these PBMCs are herein referred to as "C2-restricted PBMCs"). The targeted tumor cells and C2-restricted PBMCs were co-incubated for 24 hours at a ratio of five PBMCs to one target positive tumor cell (5:1) at 37° C. and in an atmosphere of five percent $CO_2$. Supernatants were harvested and IFN-γ concentrations were measured using a cytokine-specific IFN-γ ELISA Kit (Biolegend, Inc., San Diego, Calif., U.S.), according to manufacturer's instructions. In addition, after harvesting of supernatants, adherent target positive tumor cells were washed to remove PBMCs, and cell viability of the remaining adherent cells was assessed by CellTiter-Glo® Luminescent Cell Viability Assay (G7573 Promega Madison, Wis., U.S.), according to the manufacturer's instructions. FIGS. 15 and 16 show the results of these coincubation assays of cell-targeting-molecule-treated cell line I and HLA-A02/C2-peptide complex-detecting PBMCs (C2-restricted PBMCs) to assay intercellular T-cell recognition and engagement by measuring IFN-γ secretion and cell viability of tumor cells.

FIG. 15 shows results from the IFN-γ ELISA assay. The results show that coculture of tumor target cells (cell line I) with C2-restricted PBMCs after incubation with the cell targeting molecule "inactive SLT-1A-DI-4::scFv6::(C2)3" (SEQ ID NO:253) but not with "buffer only" results in the activation of T-cells among the PBMCs as demonstrated by the detection of IFN-γ secretion.

FIG. 16 shows results from the CellTiter-Glo® Luminescent Cell Viability Assay as measured in RLU. The results show that coculture of tumor target cells (cell line I) with C2-restricted PBMCs after incubation with the cell targeting molecule "inactive SLT-1A-DI-4::scFv6::(C2)3" (SEQ ID NO:253) but not with "buffer only" results in the activation of cytotoxic T lymphocytes among the PBMCs and target cell-killing as demonstrated by the reductions in the viability percentages for the adherent tumor target cells.

The data from the IFN-γ ELISA and CellTiter-Glo® Luminescent Cell Viability assays demonstrate that Shiga toxin effector polypeptide-mediated delivery of a fused epitope-peptide to target-positive tumor cells and the subsequent cell-surface presentation of the epitope by the tumor cells can result in the activation of specific T-cells to release effector cytokines and cause death of target tumor cells (see FIGS. 15-16).

Another coculture tumor cell viability assay was performed where the E:T ratio is kept constant at 5:1 and the concentration of the cell-targeting molecule was varied or the PBMCs were enriched for C2-restricted PBMCs. The cells used were as above with the target cells being tumor cells of cell line I and the PBMCs being C2-restricted. The results were compared to the buffer-only control. The targeted tumor cells and C2-restricted PBMCs were co-incubated for 24 hours at 37° C. and in an atmosphere of five percent $CO_2$. Adherent target positive tumor cells were washed to remove PBMCs and the CellTiter-Glo® Luminescent Cell Viability Assay was performed as described above. Table 8 shows the results of this coculture tumor cell viability assay where the administered "inactive SLT-1A-DI-4::scFv6::(C2)3" (SEQ ID NO:253) concentration tested was varied in a step-down fashion among 2 µM, 0.5 µM, and 0.125 µM. The data is presented as reduction in the percent of viability of adherent cells as measured by the IncuCyte® S3 Live-Cell Analysis System (EssenBioscience, Ann Arbor, Mich., U.S.) normalized to time-point zero (baseline viability). For IncuCyte® S3 Live-Cell imaging studies, cells were plated in standard 96-well tissue culture plates and cultured under standard conditions. Data was obtained from up to four images per well as readout by phase, red and green fluorescence via standard protocols provided by the manufacturer. Comparisons in this sample include the inclusion of PBMCs at an E:T of 5:1 that were either culture-expanded for one week prior to coculture with relevant C2 peptide (SEQ ID NO:253) or were culture-expanded for one week prior to coculture with relevant C2 peptide (SEQ ID NO:21).

TABLE 8

Intercellular Engagement of Immune Cells Recognizing C2 Epitope Presentation by Target Cells Contacted with "Inactive SLT-1A-DI-4::scFv6::(C2)3" Results in Target Cell Killing in a Dose-Dependent Manner

| Inactive SLTA-1A-DI-4::scFv6::(C2)3 concentration (µM) | Reduction in Viability of Cells in Presence of C2-Restricted PBMCs (% of T = 0) |
|---|---|
| 0.000 | 0 |
| 0.125 | 37 |
| 0.500 | 50 |
| 2.000 | 68 |

The data in Table 8 demonstrates that the quantity of target tumor cell death induced by a cell-targeting molecule of the present invention is dependent on the concentration of cell-targeting molecule administered to the target tumor cells and the enrichment of PBMCs. The coculture of target positive tumor cells pretreated with "inactive SLT-1A-DI-4::scFv6::(C2)$_3$" (SEQ ID NO:253) and C2-restricted PBMCs resulted in reductions in adherent, target tumor cell viability percentages from about 35 to 65 percent. At cell-targeting molecule concentrations as low as 0.125 µM, over 35 percent of the adherent target cells were killed in the C2-restricted PBMC-sample. This effect was dose-dependent as cell-targeting molecule concentrations of 0.5 µM and 2 µM induced a reduction in cell viability of about 50 and 65 percent, respectively. The results in Table 8 demonstrate that the concentration of cell-targeting molecule administered to the target cells affects the overall T-cell activation and subsequent killing of targeted tumor cells.

In the above experiments, the ratio of PBMCs to tumor cells was 5 to 1. Additional experiments were performed where this PBMC effector cell to target cell ("E:T") ratio was varied. Target tumor cells (cell line I) were incubated with "inactive SLT-1A-DI-4::scFv6::(C2)$_3$" (SEQ ID NO:253) at a concentration of 500 nM for four hours at 37° C. and in an atmosphere of five percent $CO_2$ followed by coculture with PBMCs at various E:T ratios) for over three days at 37° C. and in an atmosphere of five percent $CO_2$. Table 9 shows the results for cell viability of this assay at 80 hours post coculture as measured by confluence in the IncuCyte® S3 Live-Cell Analysis System. Data is presented as percent viability in relation to the buffer-only control at the assay endpoint. Comparisons are shown for conditions in the context of treatment with a fixed dose of cell-targeting molecule or "buffer only" in the presence of variable E:T ratios of PBMCs to target cells (E:T=5:1, 1:1, 05:1, and 0.1:1).

TABLE 9

PBMCs Recognizing C2 Epitope Presentation by Target Cells Contacted with "Inactive SLT-1A-DI-4::scFv6::(C2)3" Results in Target Cell Killing in an E:T-Dependent Manner

| | Treatment | |
|---|---|---|
| Effector (E) to Target (T) Ratio (E:T) | Inactive SLTA-1A-DI-4::scFv6::(C2)3 Reduction in Viability of Cells (% of "buffer only") | Buffer (negative control) Reduction in Viability of Cells (% of "buffer only") |
| 5.0:1.0 | 64 | 18 |
| 1.0:1.0 | 35 | 13 |
| 0.5:1.0 | 38 | 0 |
| 0.1:1.0 | 0 | 0 |

The data in Table 9 demonstrates that the quantity of target tumor cell death induced by a cell-targeting molecule of the present invention is dependent on the E:T ratio. Table 9 reports an observed reduction in viability of adherent cells of at least 60 percent at an E:T ratio of 5:1. Thus, more than 60 percent of the adherent target cells were killed after 80 hours. At more reduced ratios of PBMCs, less adherent cells were killed after 80 hours. At lower E:T ratios tested (1:1 and 0.5:1), less than 40 percent of the adherent target cells were killed. For the buffer-only control, less than 20 percent of the adherent target cells were killed at the highest E:T ratio of 5:1. The results in Tables 8 and 9 demonstrate that both the ratio of PBMCs to target tumor cells and the concentration of cell-targeting molecule administered to the target tumor cells contribute to the mechanism of tumor cell cytotoxicity induced by incubation with a cell-targeting molecule of the present invention, with high amounts of both cell-targeting molecule and/or PBMCs correlating with increased target cell death.

Antigen specific T-cell activation is associated with increased interactions with neighboring cells and immune cell clustering phenotypes (see e.g. Butz E, Bevan M, *Immunity* 8: 167-75 (1998)). To investigate this, another coincubation intercellular T-cell assay was performed as follows to measure lymphocyte clustering in response to target cells presenting the delivered C2 epitope complexed with MHC class I molecules. Target cells (cell line I) were incubated with 500 nM of "inactive SLT-1A-DI-4::scFv6::$(C2)_3$" (SEQ ID NO:253) for 24 hours and then co-incubated with C2-restricted PBMCs as described above. For these experiments, PBMC effectors from among the PBMCs were pre-labeled with carboxyfluorescein succinimidyl ester (CFSE), a membrane permeable dye used to track cell numbers and positions within the culture wells. After coincubation, individual PBMCs in the culture wells were imaged every four to six hours using the IncuCyte® S3 Live-Cell Analysis System (EssenBioscience, Ann Arbor, Mich., U.S.). The total number of CFSE positive cells and mean-intensity of CFSE signal were calculated via the IncuCyte® S3 software suite using the manufacturer's protocols. Immune cell clusters (CFSE-positive cell clusters of greater than 100 micron) were plotted in Prism (GraphPad Prism, San Diego, Calif., U.S.) and results of these experiments are shown in FIG. 17.

FIG. 17 shows the results of coincubation intercellular engagement assays with target cell line I cells and C2-restricted PBMCs as measured by lymphocyte clustering. The results in FIG. 17 show that incubation of tumor cells with the cell targeting molecule "inactive SLT-1A-DI-4::scFv6::(C2)3" (SEQ ID NO:253) but not "buffer only" results in the activation of cell clustering among PBMCs as measured by the aggregation of cells in clusters of greater than 100 microns in size. In addition, these PBMC cell clusters show prolonged persistence, demonstrating that treatment with a cell-targeting molecule of the present invention can promote long-term T-cell engagement upon coculture (see FIG. 17 showing persistence durations of at least 140 hours).

Much of the previous experimental data is based on the exemplary cell-targeting molecule "inactive SLT-1A-DI-4::scFv6::(C2)3" (SEQ ID NO:253). Here, are reported experimental results from testing another exemplary cell-targeting molecule: "inactive SLT-1A-DI-1::scFv8::C2" (SEQ ID NO:254).

A coincubation intercellular T-cell assay was performed as follows to quantitate the induction of intercellular T-cell engagement (e.g. target tumor cell killing) induced by treating tumor cells with "inactive SLT-1A-DI-1::scFv8::C2" (SEQ ID NO:254). Cells of cell line I, J, or K, each of which is target positive for the extracellular molecule bound by scFv8, were incubated for four hours with either 100 nM or 500 nM of "inactive SLT-1A-DI-1::scFv8::C2" (SEQ ID NO:254) or with "buffer only" at 37° C. and in an atmosphere of five percent $CO_2$. Then the cells were washed and combined with media containing "C2-restricted PBMCs". The targeted tumor cells and C2-restricted PBMCs were co-incubated for 24 hours at a ratio of five C2-restricted PBMCs to one target positive tumor cell (5:1,) at 37° C., and in an atmosphere of five percent $CO_2$. Supernatants were harvested and IFN-γ concentrations were measured using a cytokine-specific IFN-γ ELISA Kit (Biolegend, Inc., San Diego, Calif., U.S.), according to manufacturer's instructions. After harvesting of supernatants, adherent target positive tumor cells were washed to remove PBMCs, and cell viability of the remaining adherent cells was assessed by CellTiter-Glo® Luminescent Cell Viability Assay (G7573 Promega Madison, Wis., U.S.) in RLU, according to the manufacturer's instructions. As a control, parallel experiments were performed with 100 nM and 500 nM the cell-targeting molecule "inactive SLT-1A-DI-1::scFv8 (SEQ ID NO:256), which lacks any C2 epitope (SEQ ID NO:21) component but otherwise shares 100% identity with "inactive SLT-1A-DI-1::scFv8::C2" (SEQ ID NO:254).

FIGS. 18 and 19 show the results of these coincubation assays using target positive tumor cell lines I, J, and K and using cell-targeting molecules tested at different concentrations. The results show that incubating target positive tumor cells with "inactive SLT-1A-DI-1::scFv8::C2" (SEQ ID NO:254) and the coincubation with C2-restricted PBMCs results in T-cell activation, as measured by IFN-γ secretion (FIG. 18), and induces tumor cell killing via PBMCs (FIG.

19), with both effects occurring in a cell-targeting molecule concentration-dependent manner. The results show that neither "buffer only" or the negative control cell-targeting molecule lacking the of C2 epitope-peptide "inactive SLT-1A-DI-1::scFv8" (SEQ ID NO:256) was capable of inducing IFN-γ secretion after 48 hours post-coculture (FIG. 18) or target cell death during 96 hours of coculture (FIG. 19) regardless of the dose tested. Further, these data demonstrate the ability of one exemplary cell-targeting molecule of the present invention to successfully deliver a CD8+ T-cell epitope for MHC I presentation to a range of different tumor cell-types such that presentation results in intercellular T-cell engagement and target cell-killing via the action of targeted T-cells.

Much of the previous experimental data is based on "inactive" forms of exemplary cell-targeting molecules of the present invention. Here, are reported experimental results from testing an "active form" of an exemplary cell-targeting molecule of the present invention. An active cell-targeting molecule is used herein in the Examples to refer to a cell-targeting molecule which comprises a Shiga toxin effector polypeptide that is catalytically active. The exemplary cell-targeting molecule SLT-1A-DI-1::scFv8::C2 (SEQ ID NO:255) is very closely related to "inactive SLT-1A-DI-1::scFv8::C2" (SEQ ID NO:254) in that only one amino acid is different from the amino acid substitution E168D (the molecules share 99.8% identity overall and 99.6% identity between their Shiga toxin effector polypeptide components). SLT-1A-DI-1::scFv8::C2 (SEQ ID NO:255) is considered active herein with regard to its Shiga toxin A Subunit effector polypeptide which has catalytically activities comparable to a wild-type Shiga toxin A1 fragment and can kill a cell in which it is present.

A coincubation intercellular T-cell assay was performed as described above using active SLT-1A-DI-1::scFv8::C2 (SEQ ID NO:255) to quantitate intercellular T-cell engagement (e.g. target tumor cell killing and T-cell activation) induced by treating tumor cells with an active cell-targeting molecule of the present invention. Briefly, cells of cell line I were pre-incubated for four hours with "buffer alone" or with 30 or 100 nM of cell-targeting molecule SLT-1A-DI-1::scFv8::C2 (SEQ ID NO:255) and then cocultured with C2-restricted PBMCs for 48-96 hours at 37° C. and in an atmosphere of five percent $CO_2$. As a negative control, parallel experiments were performed with 30 or 100 nM of the cell-targeting molecule SLT-1A-DI-1::scFv8 (SEQ TD NO:257), which lacks any C2 epitope (SEQ ID NO:21) component but otherwise shares 100% identity with SLT-1A-DI-1::scFv8::C2 (SEQ ID NO:255). FIG. 20 shows the results for the coincubation assays.

Supernatants were harvested after 48 hours of coculture and IFN-γ concentrations were measured using the cytokine-specific IFN-γ ELISA assay as described above. FIG. 20 shows the results from the IFN-γ ELISA assay. After 96 hours of coculture, adherent target positive tumor cells were washed to remove PBMCs, and cell viability of the remaining adherent cells was assessed using the CellTiter-Glo® Luminescent Cell Viability assay as described above. FIG. 20 shows the results from the adherent cell viability assay as measured by confluence as in RLU using the IncuCyte® S3 Live-Cell Analysis System as described above.

The results shown in FIG. 20 show that a catalytically active form of a cell-targeting molecule of the present invention can function similar to an inactive cell-targeting molecule in promoting T-cell activation as measured by inducing IFN-γ secretion and immune-cell-dependent target cell killing beyond its more direct mechanism of action: cell-kill via ribosome inhibition and induction of programmed cell death. These results demonstrate the ability of exemplary cell-targeting molecules of the present invention to promote immune activation and to induce target tumor cell-killing via at least two distinct mechanisms of action, which may function cooperatively to induce more target cell death in the presence of MHC class I epitope-specific restricted PBMCs.

In addition, the activation of CTLs by target cells displaying epitope-peptide/MHC class I complexes (pMHC Is) is quantified using commercially available CTL response assays, e.g. CytoTox96® non-radioactive assays (Promega, Madison, Wis., U.S.), Granzyme B ELISpot assays (Mabtech, Inc., Cincinnati, Ohio, U.S.), caspase activity assays, and LAMP-1 translocation flow cytometric assays. To specifically monitor CTL-mediated killing of target cells, carboxyfluorescein succinimidyl ester (CFSE) is used to target-cells for in vitro and in vivo investigation as described in the art (see e.g. Durward M et al., *J Vis Exp* 45 pii 2250 (2010)).

Example 3. Melanoma Cell-Targeting Molecules Comprising Shiga Toxin A Subunit Effector Polypeptides and CD8+ T-Cell Epitope-Peptides In this Example, the Shiga toxin effector polypeptide is derived from the A subunit of Shiga-like Toxin 1 (SLT-1A) as described above with amino acid residue substitutions conferring de-immunization (see e.g. WO 2015/113005; WO 2015/113007; WO 2016/196344), CD8+ T-cell hyper-immunization (see e.g. WO 2015/113005; WO 2016/196344), and furin-cleavage resistance, such as, e.g., R248A/R251A (WO 2015/191764; WO 2016/196344). A human, CD8+ T-cell epitope-peptide is selected based on MHC I molecule binding predictions, HLA types, already characterized immunogenicities, and/or readily available reagents as described above, such as the C1-2 epitope-peptide GLDRNSGNY (SEQ ID NO:20). A proteinaceous binding region is inserted into the SLT-1A effector polypeptide which binds melanoma cells (see e.g. Cheung M et al., *Mol Cancer* 9: 28 (2010)).

Construction and Production of Melanoma Cell-Targeting Fusion Proteins

The Shiga toxin effector polypeptide and the CD8+ T-cell epitope are fused together to form a single, continuous polypeptide, such that the CD8+ T-cell epitope is not embedded or inserted in the Shiga toxin effector polypeptide.

Determining the In Vitro Characteristics of Melanoma Cell-Targeting Molecules

The binding characteristics of cell-targeting molecules of this Example for melanoma cells is determined by fluorescence-based, flow-cytometry. The Bmax for certain melanoma cell-targeting fusion proteins of this Example to positive cells is measured to be approximately 50,000-200,000 MFI with a $K_D$ within the range of 0.01-100 nM.

The ribosome inactivation abilities of melanoma cell-targeting fusion proteins of this Example are determined in a cell-free, in vitro protein translation as described above in the previous Examples. The inhibitory effect of the cell-targeting molecules of this Example on cell-free protein synthesis is significant. For certain melanoma cell-targeting fusion proteins, the $IC_{50}$ for protein synthesis in this cell-free assay is approximately 0.1-00 pM.

Determining the CD8+ Epitope-Peptide Cargo Delivery Functions of Melanoma Cell-Targeting Molecules The successful delivery of a T-cell epitope can be determined by detecting specific cell surface, MHC class I molecule/epitope complexes (pMHC Is). In order to test whether a cell-targeting molecule can deliver CD8+ T-cell epitope cargo to the MHC class I presentation pathway of target cells, routine assays are employed which detect human, MHC Class I molecules complexed with specific epitopes, such as, e.g. one or more assays described in Examples 1 and 2.

Melanoma cells treated with melanoma cell-targeting fusion proteins show a positive signal for cell-surface, C1-2-epitope/MHC class I complexes, often on the majority of the treated cells depending on the incubation duration. The detection of the T-cell epitope (e.g., C1-2 (SEQ ID NO:20)) complexed with human MHC class I molecules on the cell surface of cell-targeting molecule treated target cells demonstrates that the cell-targeting molecule is capable of entering target melanoma cells, performing sufficient sub-cellular routing, and delivering sufficient CD8+ T-cell epitope-peptide cargo to the MHC class I pathway for surface presentation by target cell.

Determining the Cytotoxicity of Melanoma Cell-Targeting Molecules Using a Cell-Kill Assay The cytotoxicity characteristics of melanoma cell-targeting fusion proteins of this Example are determined by the general cell-kill assay as described above in the previous Examples using melanoma cells. The $CD_{50}$ values of the cell-targeting molecules of this Example are approximately 0.01-100 nM for melanoma cells depending on the cell line. In addition, the induction of intermolecular CD8+ T-cell engagement of melanoma target cells presenting the delivered CD8+ T-cell epitope and cytotoxicity of melanoma cell-targeting fusion proteins of this Example is investigated for indirect cytotoxicity by heterologous, CD8+ T-cell epitope delivery and presentation leading to CTL-mediated cytotoxicity using assays known to the skilled worker and/or described herein.

Determining the In Vivo Effects of the Melanoma Cell-Targeting Molecules Using Animal Models Animal models are used to determine the in vivo effects of certain melanoma cell-targeting fusion proteins of this Example on melanoma cells (see e.g. Cheung M et al., *Mol Cancer* 9: 28 (2010)). Various mice strains are used to test the effect of intravenous administration of melanoma cell-targeting fusion proteins of this Example on human melanoma cells in mice. Cell killing effects are investigated for both direct cytotoxicity and indirect cytotoxicity by CD8+ T-cell epitope delivery and presentation leading to CTL-mediated cytotoxicity using assays known to the skilled worker and/or described herein. Optionally, "inactive" variants of the cell-targeting molecules of this Example (e.g. E167D) are used to investigate indirect cytotoxicity by CD8+ T-cell epitope delivery in the absence of the catalytic activity of any Shiga toxin effector polypeptide component of the cell-targeting molecule.

Example 4. MHC-Epitope-Complex-Targeting, Cell-Targeting Molecules Comprising Shiga Toxin A Subunit Effector Polypeptides and CD8+ T-Cell Epitope-Peptides In this Example, the Shiga toxin effector polypeptide is derived from the A subunit of Shiga-like Toxin 1 (SLT-1A) as described above with amino acid residue substitutions conferring de-immunization (see e.g. WO 2015/113005; WO 2015/113007; WO 2016/196344), CD8+ T-cell hyper-immunization (see e.g. WO 2015/113005; WO 2016/196344), and furin-cleavage resistance, such as, e.g., R248A/R251A (WO 2015/191764; WO 2016/196344). A human, CD8+ T-cell epitope-peptide is selected based on MHC I molecule binding predictions, HLA types, already characterized immunogenicities, and/or readily available reagents as described above, such as the C1-2 epitope-peptide GLDRNSGNY (SEQ ID NO:20). A proteinaceous binding region is derived from a T-cell receptor like antibody specific for a particular epitope-peptide-MHC molecule complex, such as, e.g., WT1 ab1 (US2014/294841) which is capable of specifically binding HLA-A0201 bound to a Wilms' tumor oncogene protein (WT1) epitope-peptide RMFPNAPYL. HLA-A2-WT1 complexes may be expressed by various cancer cell types, such as breast cancer, ovarian cancer, prostate cancer, chronic myelocytic leukemia, multiple myeloma (MM), acute lymphoblastic leukemia (ALL), acute myeloid/myelogenous leukemia (AML), and myelodysplastic syndrome (MDS) cancer cells.

Construction and Production of MHC-Epitope-Complex-Targeting Cell-Targeting Fusion Proteins The immunoglobulin-type binding region αHLA-WT1, the Shiga toxin effector polypeptide, and the CD8+ T-cell epitope are fused together to form a single, continuous polypeptide, such as "SLT-1A::C1-2::αHLA-WT1" or "SLT-1A::αHLA-WT1::C1-2," and, optionally, a KDEL is added to the carboxy terminus of the resulting polypeptide.

Determining the In Vitro Characteristics of MHC-Epitope-Complex-Targeting, Cell-Targeting Molecules The binding characteristics of cell-targeting molecules of this Example for specific MHC I molecule-epitope complex positive cells and negative cells is determined by fluorescence-based, flow-cytometry. The Bmax for certain MHC-epitope-complex-targeting, cell-targeting fusion proteins of this Example to positive cells is measured to be approximately 50,000-200,000 MFI with a $K_D$ within the range of 0.01-100 nM, whereas there is no significant binding to the respective MHC-epitope complex negative cells in this assay.

The ribosome inactivation abilities of MHC-epitope-complex-targeting, cell-targeting fusion proteins of this Example are determined in a cell-free, in vitro protein translation as described above in the previous Examples. The inhibitory effect of the cell-targeting molecules of this Example on cell-free protein synthesis is significant. For certain MHC-epitope-complex-targeting, cell-targeting fusion proteins, the $IC_{50}$ for protein synthesis in this cell-free assay is approximately 0.1-100 pM.

Determining the CD8+ Epitope-Peptide Cargo Delivery Functions of MHC-Epitope-Complex-Targeting, Cell-Targeting Molecules The successful delivery of a T-cell epitope can be determined by detecting specific cell surface, MHC class I molecule/epitope complexes (pMHC Is). In order to test whether a cell-targeting molecule can deliver CD8+ T-cell epitope cargo to the MHC class I presentation pathway of target cells, routine assays are employed which detect human, MHC Class I molecules complexed with specific epitopes, such as, e.g. one or more assays described in Examples 1 and 2.

Cells treated with MHC-epitope-complex-targeting, cell-targeting fusion proteins show a positive signal for cell-surface, C1-2-epitope/MHC class I complexes, often on the majority of the treated cells depending on the incubation duration. The detection of the T-cell epitope C1-2 (SEQ ID NO:20) complexed with human MHC class T molecules on the cell surface of cell-targeting molecule treated target cells demonstrates that the cell-targeting molecule is capable of entering target cells, performing sufficient sub-cellular routing, and delivering sufficient CD8+ T-cell epitope-peptide cargo to the MHC class I pathway for surface presentation by target cell.

Determining the Cytotoxicity of MHC-Epitope-Complex-Targeting, Cell-Targeting Molecules Using a Cell-Kill Assay The cytotoxicity characteristics of MHC-epitope-complex-targeting, cell-targeting fusion proteins of this Example are determined by the general cell-kill assay as described above in the previous Examples using specific MHC-epitope complex positive cells. In addition, the selective cytotoxicity characteristics of the same MHC-epitope-complex-targeting, cell-targeting fusion proteins of this Example are determined by the same general cell-kill assay using the respective MHC-epitope complex negative cells as a comparison to the appropriate MHC-epitope complex positive cells. The $CD_{50}$ values of the cell-targeting molecules of this Example are approximately 0.01-100 nM for MHC-epitope complex positive cells depending on the cell line. The $CD_{50}$ values of MHC-epitope-complex-targeting, cell-targeting fusion proteins of this Example are approximately 10-10,000 fold greater (less cytotoxic) for cells not expressing the appropriate MHC-epitope complex on a cellular surface as compared to cells which do express the appropriate MHC-epitope complex on a cellular surface. In addition, the induction of intermolecular CD8+ T-cell engagement of C1-2-presenting target cells and cytotoxicity of MHC-epitope-complex targeting, cell-targeting fusion proteins of this Example is investigated for indirect cytotoxicity by heterologous, CD8+ T-cell epitope delivery and presentation leading to CTL-mediated cytotoxicity using assays known to the skilled worker and/or described herein.

Determining the In Vivo Effects of the MHC-Epitope-Complex-Targeting, Cell-Targeting Molecules Using Animal Models Animal models are used to determine the in vivo effects of certain MHC-epitope-complex-targeting, cell-targeting fusion proteins of this Example on neoplastic cells. Various mice strains are used to test the effect of intravenous administration of MHC-epitope-complex-targeting, cell-targeting fusion proteins of this Example on specific MHC-epitope complex positive cells in mice. Cell killing effects are investigated for both direct cytotoxicity and indirect cytotoxicity by CD8+ T-cell epitope delivery and presentation leading to CTL-mediated cytotoxicity using assays known to the skilled worker and/or described herein. Optionally, "inactive" variants of the cell-targeting molecules of this Example (e.g. E167D) are used to investigate indirect cytotoxicity by CD8+ T-cell epitope delivery in the absence of the catalytic activity of any Shiga toxin effector polypeptide component of the cell-targeting molecule.

Example 5. IL-2R-Targeting, Cell-Targeting Molecules Comprising Shiga Toxin A Subunit Effector Polypeptides and CD8+ T-Cell Epitope-Peptides In this Example, the Shiga toxin effector polypeptide is derived from the A subunit of Shiga-like Toxin 1 (SLT-1A) as described above with amino acid residue substitutions conferring de-immunization (see e.g. WO 2015/113005; WO 2015/113007; WO 2016/196344), CD8+ T-cell hyper-immunization (see e.g. WO 2015/113005; WO 2016/196344), and furin-cleavage resistance, such as, e.g., R248A/R251A (WO 2015/191764; WO 2016/196344). A human, CD8+ T-cell epitope-peptide is selected based on MHC I molecule binding predictions, ILA types, already characterized immunogenicities, and/or readily available reagents as described above, such as the C1-2 epitope-peptide GLDRNSGNY (SEQ ID NO:20). A proteinaceous binding region is derived from a ligand (the cytokine interleukin 2 or IL-2) for the human interleukin 2 receptor (IL-2R), which is capable of specifically binding an extracellular part of the human IL-2R. IL-2R is a cell-surface receptor expressed by various immune cell types, such as T-cells and natural killer cells.

Construction and Production of IL-2R-Targeting, Cell-Targeting Fusion Proteins

The ligand-type binding region αIL-2R, the Shiga toxin effector polypeptide, and the CD8+ T-cell epitope are fused together to form a single, continuous polypeptide, such as "C1-2::SLT-1A::IL-2" or "IL-2::C1-2::SLT-1A," and, optionally, a KDEL is added to the carboxy terminus of the resulting polypeptide.

Determining the In Vitro Characteristics of IL-2R-Targeting, Cell-Targeting Molecules The binding characteristics of cell-targeting molecules of this Example for IL-2R positive cells and IL-2R negative cells is determined by fluorescence-based, flow-cytometry. The Bmax for certain IL-2R-targeting, cell-targeting fusion proteins of this Example to positive cells is measured to be approximately 50,000-200,000 MFI with a $K_D$ within the range of 0.01-100 nM, whereas there is no significant binding to IL-2R negative cells in this assay.

The ribosome inactivation abilities of IL-2R-targeting, cell-targeting fusion proteins of this Example are determined in a cell-free, in vitro protein translation as described above in the previous Examples. The inhibitory effect of the cell-targeting molecules of this Example on cell-free protein synthesis is significant. For certain IL-2R-targeting, cell-targeting fusion proteins, the $IC_{50}$ for protein synthesis in this cell-free assay is approximately 0.1-100 pM.

Determining the CD8+ Epitope-Peptide Cargo Delivery Functions of IL-2R-Targeting, Cell-Targeting Molecules The successful delivery of a T-cell epitope can be determined by detecting specific cell surface, MHC class T molecule/epitope complexes (pMHC Is). In order to test whether a cell-targeting molecule can deliver CD8+ T-cell epitope cargo to the MHC class I presentation pathway of target cells, routine assays are employed which detect human, MHC Class I molecules complexed with specific epitopes, such as, e.g. one or more assays described in Examples 1 and 2.

Cells treated with IL-2R-targeting, cell-targeting fusion proteins show a positive signal for cell-surface, C1-2-epitope/MHC class I complexes, often on the majority of the treated cells depending on the incubation duration. The detection of the T-cell epitope C1-2 (SEQ ID NO:20) complexed with human MHC class I molecules on the cell surface of cell-targeting molecule treated target cells demonstrates that the cell-targeting molecule is capable of entering target cells, performing sufficient sub-cellular routing, and delivering sufficient CD8+ T-cell epitope-peptide cargo to the MHC class I pathway for surface presentation by target cell.

Determining the Cytotoxicity of IL-2R-Targeting, Cell-Targeting Molecules Using a Cell-Kill Assay The cytotoxicity characteristics of IL-2R-targeting, cell-targeting fusion proteins of this Example are determined by the general cell-kill assay as described above in the previous Examples using IL-2R positive cells. In addition, the selective cytotoxicity characteristics of the same IL-2R-targeting, cell-targeting fusion proteins of this Example are determined by the same general cell-kill assay using IL-2R negative cells as a comparison to the IL-2R positive cells. The $CD_{50}$ values of the cell-targeting molecules of this Example are approximately 0.01-100 nM for IL-2R positive cells depending on the cell line. The $CD_{50}$ values of IL-2R-targeting, cell-targeting fusion proteins of this Example are approximately 10-10,000 fold greater (less cytotoxic) for cells not expressing IL-2R on a cellular surface as compared to cells which do express IL-2R on a cellular surface. In addition, the induction of intermolecular CD8+ T-cell engagement of C1-2-presenting target cells and cytotoxicity of IL-2R-targeting, cell-targeting fusion proteins of this Example is investigated for indirect cytotoxicity by heterologous, CD8+ T-cell epitope delivery and presentation leading to CTL-mediated cytotoxicity using assays known to the skilled worker and/or described herein.

Determining the In Vivo Effects of the IL-2R-Targeting, Cell-Targeting Molecules Using Animal Models Animal models are used to determine the in vivo effects of certain HL-2R-targeting, cell-targeting fusion proteins of this Example on neoplastic cells. Various mice strains are used to test the effect of intravenous administration of IL-2R-targeting, cell-targeting fusion proteins of this Example on IL-2R positive cells in mice. Cell killing effects are investigated for both direct cytotoxicity and indirect cytotoxicity by CD8+ T-cell epitope delivery and presentation leading to CTL-mediated cytotoxicity using assays known to the skilled worker and/or described herein. Optionally, "inactive" variants of the cell-targeting molecules of this Example (e.g. E167D) are used to investigate indirect cytotoxicity by CD8+ T-cell epitope delivery in the absence of the catalytic activity of any Shiga toxin effector polypeptide component of the cell-targeting molecule.

Example 6. CEA-Targeting, Cell-Targeting Molecules Comprising a Shiga Toxin Effector Polypeptide and a Heterologous, CD8+ T-Cell Epitope Carcinoembryonic antigens (CEAs) expression in adult humans is associated with cancer cells, such as, e.g., adenocarcinomas of the breast, colon, lung, pancreas, and stomach. In this example, the Shiga toxin effector polypeptide is derived from the A subunit of Shiga Toxin (StxA) (SEQ ID NO:2) as described above with amino acid residue substitutions conferring de-immunization (see e.g. WO 2015/113005; WO 2015/113007; WO 2016/196344), CD8+ T-cell hyperimmunization (see e.g. WO 2015/113005; WO 2016/196344), and furin-cleavage resistance, such as, e.g., R248A/R251A (WO 2015/191764; WO 2016/196344). A human, CD8+ T-cell epitope-peptide is selected based on MHC I molecule binding predictions, HLA types, already characterized immunogenicities, and/or readily available reagents as described above, such as the F3-epitope ILRGS-VAHK (SEQ ID NO:26) described in WO 2015/113005 and WO 2016/196344. The immunoglobulin-type, binding region αCEA, which binds specifically and with high-affinity to an extracellular antigen on human carcinoembryonic antigen (CEA), such as the tenth human fibronectin type III domain derived binding region C743 as described in Pirie C et al., *J Biol Chem* 286: 4165-72 (2011).

Construction, production, and Purification of CEA-targeting, Cell-Targeting Molecules The Shiga toxin effector polypeptide, αCEA binding region polypeptide, and heterologous, CD8+ T-cell epitope-peptide are operably linked together using standard methods known to the skilled worker to form cell-targeting molecules of the present invention. For example, fusion proteins are produced by expressing a polynucleotide encoding one or more of StxA::αCEA::F3, StxA::F3::αCEA, αCEA::StxA::F3, F3::αCEA::StxA, αCEA::F3::StxA, and F3::StxA::αCEA, which each optionally have one or more proteinaceous linkers described herein between the fused proteinaceous components. Expression of these exemplary CEA-targeting fusion proteins is accomplished using either bacterial and/or cell-free, protein translation systems as described in the previous Examples.

Determining the In Vitro Characteristics of Exemplary CEA-Targeting, Cell-Targeting Fusion Proteins The binding characteristics of cell-targeting molecule of this Example for CEA positive cells and CEA negative cells is determined by fluorescence-based, flow-cytometry. The $B_{max}$ for StxA:αCEA::F3, StxA::F3::αCEA, αCEA::StxA::F3, F3::αCEA::StxA, αCEA::F3::StxA, and F3::StxA::αCEA to CEA positive cells are each measured to be approximately 50,000-200,000 MFI with a $K_D$ within the range of 0.01-100 nM, whereas there is no significant binding to CEA negative cells in this assay.

The ribosome inactivation abilities of the fusion proteins of this Example are determined in a cell-free, in vitro protein translation as described above in the previous Examples. The inhibitory effect of the cytotoxic fusion proteins of this Example on cell-free protein synthesis are significant. The $IC_{50}$ values on protein synthesis in this cell-free assay measured for StxA::αCEA::F3, StxA::F3::αCEA, αCEA:: StxA::F3, F3::αCEA::StxA, αCEA::F3::StxA, and F3:: StxA::αCEA are each approximately 0.1-100 pM.

Determining the CD8+ Epitope-Peptide Cargo Delivery Functions of CEA-Targeting, Cell-Targeting Molecules The successful delivery of a T-cell epitope can be determined by detecting specific cell surface, MHC class I molecule/epitope complexes (pMHC Is). In order to test whether a cell-targeting molecule can deliver CD8+ T-cell epitope cargo to the MHC class I presentation pathway of target cells, routine assays are employed which detect human, MHC Class I molecules complexed with specific epitopes, such as, e.g. one or more assays described in Examples 1 and 2.

Cells treated with CEA-targeting, cell-targeting fusion proteins show a positive signal for cell-surface, F3-epitope/MHC class I complexes, often on the majority of the treated cells depending on the incubation duration. The detection of the CD8+ T-cell epitope F3 (SEQ ID NO:26) complexed with human MHC class I molecules on the cell surface of cell-targeting molecule treated target cells demonstrates that the cell-targeting molecule is capable of entering target cells, performing sufficient sub-cellular routing, and delivering sufficient CD8+ T-cell epitope-peptide cargo to the MHC class I pathway for surface presentation by target cell.

Determining the Cytotoxicity of Exemplary CEA-Targeting, Cell-Targeting Fusion Proteins Using a Cell-Kill Assay The cytotoxicity characteristics of cell-targeting molecule of this Example are determined by the general cell-kill assay as described above in the previous Examples using CEA positive cells. In addition, the selective cytotoxicity characteristics of the exemplary CEA-targeting, cell-targeting fusion proteins are determined by the same general cell-kill assay using CEA negative cells as a comparison to the CEA antigen positive cells. The $CD_{50}$ values measured for StxA:: αCEA::F3, StxA::F3::αCEA, αCEA::StxA::F3, F3:: αCEA::StxA, αCEA::F3::StxA, and F3::StxA::αCEA are approximately 0.01-100 nM for CEA positive cells depending on the cell line. The $CD_{50}$ values of the CEA-targeting, cell-targeting fusion proteins of this Example are approximately 10-10,000 fold greater (less cytotoxic) for cells not expressing CEA on a cellular surface as compared to cells which do express CEA on a cellular surface. In addition, the induction of intermolecular CD8+ T-cell engagement of F3-presenting target cells and cytotoxicity of StxA::αCEA:: F3, StxA::F3::αCEA, αCEA::StxA::F3, F3::αCEA::StxA, αCEA::F3::StxA, and F3::StxA::αCEA is investigated for indirect cytotoxicity by heterologous, CD8+ T-cell epitope delivery and presentation leading to CTL-mediated cytotoxicity using assays known to the skilled worker and/or described herein.

Determining the In Vivo Effects of an Exemplary CEA-Targeting, Cell-Targeting Fusion Protein Using Animal Models Animal models are used to determine the in vivo effects exemplary CEA-targeting fusion proteins on neoplastic cells. Various mice strains are used to test the effects on xenograft tumors of the cell-targeting fusion proteins StxA::αCEA::F3, StxA::F3::αCEA, αCEA::StxA::F3, F3::αCEA::StxA, αCEA::F3::StxA, and F3::StxA::αCEA after intravenous administration to mice injected with human neoplastic cells which express CEA(s) on their cell surfaces. Cell killing is investigated for both direct cytotoxicity and indirect cytotoxicity by CD8+ T-cell epitope cargo delivery and presentation leading to CTL-mediated cytotoxicity using assays known to the skilled worker and/or described herein. Optionally, "inactive" variants of the cell-targeting molecules of this Example (e.g. E167D) are used to investigate indirect cytotoxicity caused by CD8+ T-cell epitope delivery in the absence of the catalytic activity of any Shiga toxin effector polypeptide component of the cell-targeting molecule.

Example 7. HER2-Targeting, Cell-Targeting Molecules Comprising a Shiga Toxin Effector Polypeptide and a Heterologous, CD8+ T-Cell Epitope HER2 overexpression has been observed in breast, colorectal, endometrial, esophageal, gastric, head and neck, lung, ovarian, prostate, pancreatic, and testicular germ cell tumor cells. In this Example, the Shiga toxin effector polypeptide is derived from the A Subunit of StxA (SEQ ID NO:2) as described above with amino acid residue substitutions conferring de-immunization (see e.g. WO 2015/113005; WO 2015/113007; WO 2016/196344), CD8+ T-cell hyperimmunization (see e.g. WO 2015/113005; WO 2016/196344), and furin-cleavage resistance, such as, e.g., R248A/R251A (WO 2015/191764; WO 2016/196344). A human, CD8+ T-cell epitope-peptide is selected based on MHC I molecule binding predictions, HLA types, already characterized immunogenicities, and/or readily available reagents as described above, such as the C3-epitope GVMTRGRLK (SEQ ID NO:22) described in WO 2015/113005 and WO 2016/196344. The binding region αHER2, which binds an extracellular part of human HER2, is generated by screening or selected from available immunoglobulin-type polypeptides known to the skilled worker (see e.g. the ankyrin repeat DARPin™ G3 which binds with high affinity to an extracellular epitope of HER2 (Goldstein R et al., *Eur J Nucl Med Mol Imaging* 42: 288-301 (2015))).

Construction, Production, and Purification of HER2-Targeting, Cell-Targeting Molecules The Shiga toxin effector polypeptide, αHER2 binding region polypeptide, and heterologous, CD8+ T-cell epitope-peptide are operably linked together using standard methods known to the skilled worker to form cell-targeting molecules of the present invention. For example, fusion proteins are produced by expressing a polynucleotide encoding one or more of StxA::αHER2::C3, StxA::C3::αHER2, αHER2::StxA::C3, C3::αHER2::StxA, αHER2::C3::StxA, and C3::StxA::αHER2, which each optionally have one or more proteinaceous linkers described herein between the fused proteinaceous components. Expression of these exemplary HER2-targeting fusion proteins is accomplished using either bacterial and/or cell-free, protein translation systems as described in the previous Examples.

Determining the In Vitro Characteristics of Exemplary HER2-Targeting, Cell-Targeting Fusion Proteins The binding characteristics of cell-targeting molecule of this Example for HER2 positive cells and HER2 negative cells is determined by fluorescence-based, flow-cytometry. The $B_{max}$ for StxA::αHER2::C3, StxA::C3::αHER2, αHER2::StxA::C3, C3::αHER2::StxA, αHER2::C3::StxA, and C3::StxA::αHER2 to HER2 positive cells are each measured to be approximately 50,000-200,000 MFI with a $K_D$ within the range of 0.01-100 nM, whereas there is no significant binding to HER2 negative cells in this assay.

The ribosome inactivation abilities of the fusion proteins of this Example are determined in a cell-free, in vitro protein translation as described above in the previous Examples. The inhibitory effect of the cytotoxic fusion proteins of this Example on cell-free protein synthesis are significant. The $IC_{50}$ values on protein synthesis in this cell-free assay measured for StxA::αHER2::C3, StxA::C3::αHER2, αHER2::StxA::C3, C3::αHER2::StxA, αHER2::C3::StxA, and C3::StxA::αHER2 are each approximately 0.1-100 pM.

Determining the CD8+ Epitope-Peptide Cargo Delivery Functions of HER2-Targeting, Cell-Targeting Molecules The successful delivery of a T-cell epitope can be determined by detecting specific cell surface, MHC class I molecule/epitope complexes (pMHC Is). In order to test whether a cell-targeting molecule can deliver CD8+ T-cell epitope cargo to the MHC class I presentation pathway of target cells, routine assays are employed which detect human, MHC Class I molecules complexed with specific epitopes, such as, e.g. one or more assays described in Examples 1 and 2.

Cells treated with HER2-targeting, cell-targeting fusion proteins show a positive signal for cell-surface, C3-epitope/MHC class I complexes, often on the majority of the treated cells depending on the incubation duration. The detection of the CD8+ T-cell epitope C3 (SEQ ID NO:22) complexed with human MHC class I molecules on the cell surface of cell-targeting molecule treated target cells demonstrates that the cell-targeting molecule is capable of entering target cells, performing sufficient sub-cellular routing, and delivering sufficient CD8+ T-cell epitope-peptide cargo to the MHC class I pathway for surface presentation by target cell.

Determining the Cytotoxicity of Exemplary HER2-Targeting, Cell-Targeting Fusion Proteins Using a Cell-Kill Assay The cytotoxicity characteristics of cell-targeting molecule of this Example are determined by the general cell-kill assay as described above in the previous Examples using HER2 positive cells. In addition, the selective cytotoxicity characteristics of the exemplary HER2-targeting, cell-targeting fusion proteins are determined by the same general cell-kill assay using HER2 negative cells as a comparison to the HER2 antigen positive cells. The $CD_{50}$ values measured for StxA::αHER2::C3, StxA::C3::αHER2, αHER2::StxA::C3, C3::αHER2::StxA, αHER2::C3::StxA, and C3::StxA::αHER2 are approximately 0.01-100 nM for HER2 positive cells depending on the cell line. The $CD_{50}$ values of the HER2-targeting, cell-targeting fusion proteins of this Example are approximately 10-10,000 fold greater (less cytotoxic) for cells not expressing HER2 on a cellular surface as compared to cells which do express HER2 on a cellular surface. In addition, the induction of intermolecular CD8+ T-cell engagement of C3-presenting target cells and cytotoxicity of StxA::αHER2::C3, StxA::C3::αHER2, αHER2::StxA::C3, C3::αHER2::StxA, αHER2::C3::StxA, and C3::StxA::αHER2 is investigated for indirect cytotoxicity by heterologous, CD8+ T-cell epitope delivery and presentation leading to CTL-mediated cytotoxicity using assays known to the skilled worker and/or described herein. Determining the In Vivo Effects of an Exemplary HER2-Targeting, Cell-Targeting Fusion Protein Using Animal Models Animal models are used to determine the in vivo effects exemplary HER2-targeting fusion proteins on neoplastic cells. Various mice strains are used to test the effects on xenograft tumors of the cell-targeting fusion proteins StxA::αHER2::C3, StxA::C3::αHER2, αHER2::StxA::C3, C3::αHER2::StxA, αHER2::C3::StxA, and C3::StxA::αHER2 after intravenous administration to mice injected with human neoplastic cells which express HER2(s) on their cell surfaces. Cell killing is investigated for both direct cytotoxicity and indirect cytotoxicity by CD8+ T-cell epitope cargo delivery and presentation leading to CTL-mediated cytotoxicity using assays known to the skilled worker and/or described herein. Optionally, "inactive" variants of the cell-targeting molecules of this Example (e.g. E167D) are used to investigate indirect cytotoxicity caused by CD8+ T-cell epitope delivery in the absence of the catalytic activity of any Shiga toxin effector polypeptide component of the cell-targeting molecule.

Example 8. Cell-Targeting Molecules Targeting Various Cell-Types, Each Comprising a Shiga Toxin A Subunit Effector Polypeptide and One or More, Heterologous, CD8+ T-Cell Epitope-Peptides Located Carboxy-Terminal to the Shiga Toxin A Subunit Effector Polypeptide Component In this Example, three proteinaceous structures are associated with each other to form exemplary, cell-targeting molecules of the present invention. In this Example, the Shiga toxin effector polypeptide is derived from the A Subunit of SLT-1A (SEQ ID NO:1) as described above with amino acid residue substitutions conferring de-immunization (see e.g. WO 2015/113005; WO 2015/113007; WO 2016/196344), CD8+ T-cell hyperimmunization (see e.g. WO 2015/113005; WO 2016/196344), and furin-cleavage resistance, such as, e.g., R248A/R251A (WO 2015/191764; WO 2016/196344) One or more CD8+ T-cell epitope-peptides are selected, such as, e.g., based on MHC I molecule binding predictions, HLA types, already characterized immunogenicities, and/or readily available reagents as described herein. A binding region component is derived from the immunoglobulin domain from the molecule chosen from column 1 of Table 10 and which binds the extracellular target biomolecule indicated in column 2 of Table 10.

Using reagents and techniques known in the art, the three components: 1) the ligand or immunoglobulin-derived binding region, 2) the Shiga toxin effector polypeptide, and 3) the CD8+ T-cell epitope-peptide(s) or a larger polypeptide comprising at least one heterologous CD8+ T-cell epitope-peptide, are associated with each other to form a cell-targeting molecule of the present invention and, optionally, the CD8+ T-cell epitope-peptide is located carboxy-terminal to the carboxy terminus of the Shiga toxin A1 fragment region of a the Shiga toxin effector polypeptide which optionally comprises a disrupted furin-cleavage motif. The exemplary cell-targeting molecules of this Example are tested as described in the previous Examples using cells expressing the appropriate extracellular target biomolecules. The exemplary cell-targeting molecules of this Example may be used, e.g., to diagnose and treat diseases, conditions, and/or disorders indicated in column 3 of Table 10.

TABLE 10

Various Binding Regions for Cell Targeting

| Source of binding region | Extracellular target | Application(s) |
|---|---|---|
| alemtuzumab | CD52 | B-cell cancers, such as lymphoma and leukemia, and B-cell related immune disorders, such as autoimmune disorders |
| basiliximab | CD25 | T-cell disorders, such as prevention of organ transplant rejections, and some B-cell lineage cancers |
| brentuximab | CD30 | hematological cancers, B-cell related immune disorders, and T-cell related immune disorders |
| catumaxomab | EpCAM | various cancers, such as ovarian cancer, malignant ascites, gastric cancer |
| cetuximab | EGFR | various cancers, such as colorectal cancer and head and neck cancer |
| daclizumab | CD25 | B-cell lineage cancers and T-cell disorders, such as rejection of organ transplants |
| daratumumab | CD38 | hematological cancers, B-cell related immune disorders, and T-cell related immune disorders |
| dinutuximab | ganglioside GD2 | Various cancers, such as breast cancer, myeloid cancers, and neuroblastoma |
| efalizumab | LFA-1 (CD11a) | autoimmune disorders, such as psoriasis |
| ertumaxomab | HER2/neu | various cancers and tumors, such as breast cancer and colorectal cancer |
| gemtuzumab | CD33 | myeloid cancer or immune disorder |
| ibritumomab | CD20 | B-cell cancers, such as lymphoma and leukemia, and B-cell related immune disorders, such as autoimmune disorders |

TABLE 10-continued

Various Binding Regions for Cell Targeting

| Source of binding region | Extracellular target | Application(s) |
|---|---|---|
| inotuzumab | CD22 | B-cell cancers, such as lymphoma and leukemia, and B-cell related immune disorders, such as autoimmune disorders |
| ipilimumab | CD152 | T-cell related disorders and various cancers, such as leukemia, melanoma |
| muromonab | CD3 | prevention of organ transplant rejections |
| natalizumab | initegrin α4 | autoimmune disorders, such as multiple sclerosis and Crohn's disease |
| obinutuzumab | CD20 | B-cell cancers, such as lymphoma and leukemia, and B-cell related immune disorders, such as autoimmune disorders |
| ocaratuzumab | CD20 | B-cell cancers, such as lymphoma and leukemia, and B-cell related immune disorders, such as autoimmune disorders |
| ocrelizumab | CD20 | B-cell cancers, such as lymphoma and leukemia, and B-cell related immune disorders, such as autoimmune disorders |
| ofatumumab | CD20 | B-cell cancers, such as lymphoma and leukemia, and B-cell related immune disorders, such as autoimmune disorders |
| palivizumab | F protein of respiratory syncytial virus | treat respiratory syncytial virus |
| panitumumab | EGFR | various cancers, such as colorectal cancer and head and neck cancer |
| pertuzumab | HER2/neu | various cancers and tumors, such as breast cancer and colorectal cancer |
| pro 140 | CCR5 | HIV infection and T-cell disorders |
| ramucirumab | VEGFR2 | various cancers and cancer related disorders, such as solid tumors |
| rituximab | CD20 | B-cell cancers, such as lymphoma and leukemia, and B-cell related immune disorders, such as autoimmune disorders |
| tocilizumab or atlizumab | IL-6 receptor | autoimmune disorders, such as rheumatoid arthritis |
| tositumomab | CD20 | B-cell cancers, such as lymphoma and leukemia, and B-cell related immune disorders, such as autoimmune disorders |
| trastuzumab | HER2/neu | various cancers and tumors, such as breast cancer and colorectal cancer |
| ublituximab | CD20 | B-cell cancers, such as lymphoma and leukemia, and B-cell related immune disorders, such as autoimmune disorders |
| vedolizumab | integrin α4β7 | autoimmune disorders, such as Crohn's disease and ulcerative colitis |
| CD20 binding scFv(s) Geng S et al., *Cell Mol Immunol* 3: 439-43 (2006); Olafesn T et al., *Protein Eng Des Sel* 23: 243-9 (2010) | CD20 | B-cell cancers, such as lymphoma and leukemia, and B-cell related immune disorders, such as autoimmune disorders |
| CD22 binding scFv(s) Kawas S et al., *MAbs* 3: 479-86 (2011) | CD22 | B-cell cancers or B-cell related immune disorders |
| CD25 binding scFv(s) Muramatsu H et al., *Cancer Lett* 225: 225-36 (2005) | CD25 | various cancers of the B-cell lineage and immune disorders related to T-cells |
| CD30 binding monoclonal antibody(s) Klimka A et al., *Br J Cancer* 83: 252-60 (2000) | CD30 | B-cell cancers or B-cell/T-cell related immune disorders |
| CD33 binding monoclonal antibody(s) Benedict C et al., *J Immunol Methods* 201: 223-31 (1997) | CD33 | myeloid cancer or immune disorder |
| CD38 binding immunoglobulin domains U.S. Pat. No. 8,153,765 | CD38 | hematological cancers, B-cell related immune disorders, and T-cell related immune disorders |

TABLE 10-continued

Various Binding Regions for Cell Targeting

| Source of binding region | Extracellular target | Application(s) |
| --- | --- | --- |
| CD40 binding scFv(s) Ellmark P et al., *Immunology* 106: 456-63 (2002) | CD40 | various cancers and immune disorders |
| CD52 binding monoclonal antibody(s) U.S. Pat. No. 7,910,104 B2 | CD52 | B-cell cancers, such as lymphoma and leukemia, and B-cell related immune disorders, such as autoimmune disorders |
| CD56 binding monoclonal antibody(s) Shin J et al., *Hybridoma* 18: 521-7 (1999) | CD56 | immune disorders and various cancers, such as lung cancer, Merkel cell carcinoma, myeloma |
| CD79 binding monoclonal antibody(s) Zhang L et al., *Ther Immunol* 2: 191-202 (1995) | CD79 | B-cell cancers or B-cell related immune disorders |
| CD248 binding scFv(s) Zhao A et al., *J Immunol Methods* 363: 221-32 (2011) | CD248 | various cancers, such as inhibiting angiogenesis |
| EpCAM binding monoclonal antibody(s) Schanzer J et al., *J Immunother* 29: 477-88 (2006) | EpCAM | various cancers, such as ovarian cancer, malignant ascites, gastric cancer |
| PSMA binding monoclonal antibody(s) Frigerio B et al., *Eur J Cancer* 49: 2223-32 (2013) | PSMA | prostate cancer |
| Eph-B2 binding monoclonal antibody(s) Abéngozar M et al., *Blood* 119: 4565-76 (2012) | Eph-B2 | for various cancers such as colorectal cancer and prostate cancer |
| Endoglin binding monoclonal antibody(s) Völkel T et al., *Biochim Biophys Res Acta* 1663: 158-66 (2004) | Endoglin | various cancers, such as breast cancer and colorectal cancers |
| FAP binding monoclonal antibody(s) Zhang J et al., *FASEB J* 27: 581-9 (2013) | FAP | various cancers, such as sarcomas and bone cancers |
| CEA binding antibody(s) and scFv(s) Neumaier M et al., *Cancer Res* 50: 2128-34 (1990); Pavoni E et al., *BMC Cancer* 6: 4 (2006); Yazaki P et al., *Nucl Med Biol* 35: 151-8 (2008); Zhao J et al., *Oncol Res* 17: 217-22 (2008) | CEA | various cancers, such as gastrointestinal cancer, pancreatic cancer, lung cancer, and breast cancer |
| CD24 binding monoclonal anlibody(s) Kristiansen G et al., *Lab Invest* 90: 1102-16 (2010) | CD24 | various cancers, such as bladder cancer |
| LewisY antigen binding scFv(s) Power B et al., *Protein Sci* 12: 734-47 (2003); monoclonal antibody BR96 Feridani A et al., *Cytometry* 71: 361-70 (2007) | LewisY antigens | various cancers, such as cervical cancer and uterine cancer |

TABLE 10-continued

Various Binding Regions for Cell Targeting

| Source of binding region | Extracellular target | Application(s) |
|---|---|---|
| adalimumab | TNF-α | various cancers and immune disorders, such as Rheumatoid arthritis, Crohn's Disease, Plaque Psoriasis, Psoriatic Arthritis, Ankylosing Spondylitis, Juvenile Idiopathic Arthritis, Hemolytic disease of the newborn |
| afelimomab | TNF-α | various cancers and immune disorders |
| ald518 | IL-6 | various cancers and immune disorders, such as rheumatoid arthritis |
| anrukinzumab or ima-638 | IL-13 | various cancers and immune disorders |
| briakinumab | IL-12, IL-23 | various cancers and immune disorders, such as psoriasis, rheumatoid arthritis, inflammatory bowel diseases, multiple sclerosis |
| brodalumab | IL-17 | various cancers and immune disorders, such as inflammatory diseases |
| canakinumab | IL-1 | various cancers and immune disorders, such as rheumatoid arthritis |
| certolizumab | TNF-α | various cancers and immune disorders, such as Crohn's disease |
| fezakinumab | IL-22 | various cancers and immune disorders, such as rheumatoid arthritis, psoriasis |
| ganitumab | IGF-I | various cancers |
| golimumab | TNF-α | various cancers and immune disorders, such as rheumatoid arthritis, psoriatic arthritis, ankylosing spondylitis |
| infliximab | TNF-α | various cancers and immune disorders, such as rheumatoid arthritis, ankylosing spondylitis, psoriatic arthritis, psoriasis, Crohn's disease, ulcerative colitis |
| ixekizumab | TL-17A | various cancers and immune disorders, such as autoimmune diseases |
| mepolizumab | IL-5 | various immune disorders and cancers, such as B-cell cancers |
| nerelimomab | TNF-α | various cancers and immune disorders |
| olokizumab | IL6 | various cancers and immune disorders |
| ozoralizumab | TNF-α | inflammation |
| perakizumab | IL17A | various cancers and immune disorders, such as arthritis |
| placulumab | human TNF | various immune disorders and cancers |
| sarilumab | IL6 | various cancers and immune disorders, such as rheumatoid arthritis, ankylosing spondylitis |
| siltuximab | IL-6 | various cancers and immune disorders |
| sirukumab | IL-6 | various cancers and immune disorders, such as rheumatoid arthritis |
| tabalumab | BAFF | B-cell cancers |
| ticilimumab or tremelimumab | CTLA-4 | various cancers |
| tildrakizumab | IL23 | immunologically mediated inflammatory disorders |
| tnx-650 | IL-13 | various cancers and immune disorders, such as B-cell cancers |
| tocilizumab or atlizumab | IL-6 receptor | various cancers and immune disorders, such as rheumatoid arthritis |
| ustekinumab | IL-12, IL-23 | various cancers and immune disorders, such as multiple sclerosis, psoriasis, psoriatic arthritis |
| Various growth factors: VEGF, EGF1, EGF2, FGF | VEGFR, EGFR, FGFR | various cancer, such as breast cancer and colon cancer, and to inhibit vascularization |
| Various cytokines: IL-2, IL-6, IL-23, CCL2, BAFFs, TNFs, RANKL | IL-2R, IL-6R, IL-23R, CD80/CD86, TNFRSF13/ TNFRSF17, TNFR | various immune disorders and cancers |
| Broadly neutralizing antibodies identified from patient samples Prabakaran et al., *Front Microbiol* 3: 277 (2012) | Influenza surface antigens, e.g. hemagglutinins and influenza matrix protein 2 | viral infections |

TABLE 10-continued

Various Binding Regions for Cell Targeting

| Source of binding region | Extracellular target | Application(s) |
|---|---|---|
| Broadly neutralizing antibodies identified from patient samples Prabakaran et al., *Front Microbiol* 3: 277 (2012) | Coronavirus surface antigens | viral infections |
| Broadly neutralizing antibodies identified from patient samples Prabakaran et al., *Front Microbiol* 3: 277 (2012) | Henipaviruses surface antigens | viral infections |

While some embodiments of the invention have been described by way of illustration, it will be apparent that the invention may be put into practice with many modifications, variations and adaptations, and with the use of numerous equivalents or alternative solutions that are within the scope of persons skilled in the art, without departing from the spirit of the invention or exceeding the scope of the claims.

All publications, patents, and patent applications are herein incorporated by reference in their entirety to the same extent as if each individual publication, patent or patent application was specifically and individually indicated to be incorporated by reference in its entirety. The international patent application publications WO 2014/164693, WO 2014/164680, WO 2015/138435, WO 2015/138452, WO 2015/113005, WO 2015/113007, WO 2015/191764, WO 2016/19634, and WO 2017/019623, are each incorporated herein by reference in its entirety. The disclosures of U.S. patent application publications US 2007/298434, US 2009/156417, US 2013/196928, US 2016/177284, US 2017/143814, and US 2017/275382 are each incorporated here by reference in their entirety. The disclosure of international PCT patent application serial number PCT/US2017/065074 is incorporated herein by reference in its entirety. The complete disclosures of all electronically available biological sequence information from GenBank (National Center for Biotechnology Information, U.S.) for amino acid and nucleotide sequences cited herein are each incorporated herein by reference in their entirety.

Sequence Listing

| ID Number | Text Description | Biological Sequence |
|---|---|---|
| SEQ ID NO: 1 | Shiga-like toxin I Subunit A (SLT-1A) | KEFTLDFSTAKTYVDSLNVIRSAIGTPLQTISSGGTSLLMIDSGS GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSINAILGSVALILNCHHASRVARMASDEF PSMCPADGRVRGITHNKILWDSSTLGAILMRRTISS |
| SEQ ID NO: 2 | Shiga toxin Subunit A (StxA) | KEFTLDFSTAKTYVDSLNVIRSAIGTPLQTISSGGTSLLMIDSGT GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSINAILGSVALILNCHHASRVARMASDEF PSMCPADGRVRGITHNKILWDSSTLGAILMRRTISS |
| SEQ ID NO: 3 | Shiga-like toxin 2 Subunit A (SLT-2A) | DEFTVDFSSQKSYVDSLNSIRSAISTPLGNISQGGVSVSVINHV LGGNYISLNVRGLDPYSERFNHLRLIMERNNLYVAGFINTETN IFYRFSDFSHISVPDVITVSMTTDSSYSSLQRIADLERTGMQIGR HSLVGSYLDLMEFRGRSMTRASSRAMLRFVTVIAEALRFRQI QRGFRPALSEASPLYTATTAQDVDLTLNWGRISNVLPEYRGEE GVRIGRISFNSLSAILGSVAVILNCHSTGSYSVRSVSQKQKTEC QIVGDRAAIKVNNVLWEANTIAALLNRKPQDLTEPNQ |
| SEQ ID NO: 4 | Shiga toxin subtype c Subunit A (Stx1cA) | KETTLDFSTAKTYVDSLNVIRSAIGTPLQTISSGGTSLLMIDSGT GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSVNAILGSVAIALNCHHASRVAR |
| SEQ ID NO: 5 | Shiga toxin subtype d Subunit A (Stx1dA) | KEFTLDFSTAKKYVDSLNVIRSAIGTPLQTISSGGTSLLMIDSG TGDNLFAVDIMGLEPEEERFNNLRLIVERNNLYVTGFVNRTN NVFYRFADFSHVTFPGTRAVTLSGDSSYTTLQRVAGISRTGM QINRHSLTTSYLDLMSYSGTSLTQSVARAMLRFVTVTAEALRF |

Sequence Listing

| ID Number | Text Description | Biological Sequence |
|---|---|---|
| | | RQIQRGFRTTLDDLSGRSYVMTAEDVDLTLNWGRLSSILPDY<br>HGQDSVRVGRISFGSINAILGSVALILNCHHHASRVAR |
| SEQ ID NO: 6 | Shiga toxin subtype e Subunit A (Stx1eA) | QDFTVDFSTAKKYVDSLNAIRSAIGTPLHSISSGGTSLLMIDNG<br>TGDNLFAVDIRGLDPEEERFDNLRLIIERNNLYVTGFVNRTSNI<br>FYRFADFSHVTFPGTRAVTLSGDSSYTTLQRVAGIGRTGMQIN<br>RHSLTTSYLDLMSYSGSSLTQPVARAMLRFVTVTAEALRFRQI<br>QRGFRTTLDDVSGHSYTMTVEDVDLTLNWGRLSSVLPDYHG<br>QDSVRVGRISFGGVNAILGSVALILNCHHHTSRVSR |
| SEQ ID NO: 7 | Shiga toxin subtype 2c Subunit A (Stx2cA) variant 1 | REFTIDFSTQQSYVSSLNSIRTEISTPLEHISQGTTSVSVINHTPP<br>GSYFAVDIRGLDVYQARFDHLRLIIEQNNLYVAGFVNTATNTF<br>YRFSDFTHISVPGVTTVSMTTDSSYTTLQRVAALERSGMQIN<br>HSLVSSYLALMEFSGNTMTRDASRAVLRFVTVTAEALRFRQI<br>QREFRQALSETAPVYTMTPGDVDLTLNWGRISNVLPEYRGED<br>GVRVGRISFNNISAILGTVAVILNCHHQGARSVR |
| SEQ ID NO: 8 | Shiga toxin subtype 2c Subunit A (Stx2cA) variant 2 | REFTIDFSTQQSYVSSLNSIRTEISTPLEHISQGTTSVSVINHTPP<br>GSYFAVDIRGLDVYQARFDHLRLIIEQNNLYVAGFVNTATNTF<br>YRFSDFAHISVPGVTTVSMTTDSSYTTLQRVAALERSGMQISR<br>HSLVSSYLALMEFSGNTMTRDASRAVLRFVTVTAEALRFRQI<br>QREFRQALSETAPVYTMTPGDVDLTLNWGRISNVLPEYRGED<br>GVRVGRISFNNISAILGTVAVILNCHHQGARSVR |
| SEQ ID NO: 9 | Shiga toxin subtype 2c Subunit A (Stx2cA) variant 3 | REFTIDFSTQQSYVSSLNSIRTEISTPLEHISQGTTSVSVINHTPP<br>GSYFAVDIRGLDIYQARFDHLRLIIEQNNLYVAGFVNTATNTF<br>YRFSDFTHISVPGVTTVSMTTDSSYTTLQRVAALERSGMQLSR<br>HSLVSSYLALMEFSGNTMTRDASRAVLRFVTVTAEALRFRQI<br>QREFRQALSETAPVYTMTPGDVDLTLNWGRISNVLPEYRGED<br>GVRVGRISFNNISAILGTVAVILNCHHQGARSVR |
| SEQ ID NO: 10 | Shiga toxin subtype 2c Subunit A (Stx2cA) variant 4 | REFTIDFSTQQSYVSSLNSIRTEISTPLEHISQGTTSVSVINHTPP<br>GSYFAVDIRGLDVYQARFDHLRLIIEQNNLYVAGFVNTATNTF<br>YRFSDFTHISVPSVTTVSMTTDSSYTTLQRVAALERSGMQISR<br>HSLVSSYLALMEFSGNTMTRDASRAVLRFVTVTAEALRFRQI<br>QREFRQALSETAPVYTMTPGDVDLTLNWGRISNVLPEYRGED<br>GVRVGRISFNNISAILGTVAVILNCHHQGARSVR |
| SEQ ID NO: 11 | Shiga toxin subtype 2c Subunit A (Stx2cA) variant 5 | REFTIDFSTQQSYVSSLNSIRTEISTPLEHISQGTTSVSVINHTPP<br>GSYFAVDIRGLDVYQARFDHLRLIIEQNNLYMAGFVNTATNT<br>FYRFSDFTHISVPSVTTVSMTTDSSYTTLQRVAALERSGMQISR<br>HSLVSSYLALMEFSGNTMTRDASRAVLRFVTVTAEALRFRQI<br>QREFRQALSETAPVYTMTPGDVDLTLNWGRISNVLPEYRGED<br>GVRVGRISFNNISAILGTVAVILNCHHQGARSVR |
| SEQ ID NO: 12 | Shiga toxin subtype 2c Subunit A (Stx2cA) variant 6 | REFTIDFSTQQSYVSSLNSIRTEISTPLEHISQGTTSVSVINHTPP<br>GSYFAVDIRGLDVYQARFDHLRLIIEQNNLYVAGFVNTATNTF<br>YRFSDFTHISVPGVTTVSMTTDSSYTTLQRVAALERSGMQISR<br>HSLVSSYLALMEFSGNTMTRDASRAVLRFVTVTAEALRFRQI<br>QREFRQVLSETAPVYTMTPGDVDLTLNWGRISNVLPEYRGED<br>GVRVGRISFNNISAILSTVAVILNCHHQGARSVR |
| SEQ ID NO: 13 | Shiga toxin subtype 2d Subunit A (Stx2dA) variant 1 | REFTIDFSTQQSYVSSLNSIRTEISTPLEHISQGTTSVSVINHTPP<br>GSYFAVDIRGLDVYQARFDHLRLIIEQNNLYVAGFVNTATNTF<br>YRFSDFAHISVPGVTTVSMTTDSSYTTLQRVAALERSGMQISR<br>HSLVSSYLALMEFSGNTMTRDASRAVLRFVTVTAEALRFRQI<br>QREFRQALSETAPVYTMTPGDVDLTLNWGRISNVIPEYRGED<br>GVRVGRISFNNISAILGTVAVILNCHHQGARSVR |
| SEQ ID NO: 14 | Shiga toxin subtype 2d Subunit A (Stx2dA) variant 2 | REFMIDFSTQQSYVSSLNSIRTEISTPLEHISQGTTSVSVINHTPP<br>GSYFAVDIRGLDVYQARFDHLRLIIEQNNLYVAGFVNTATNTF<br>YRFSDFTHISVPGVTTVSMTTDSSYTTLQRVAALERSGMQISR<br>HSLVSSYLALMEFSGNTMTRDASRAVLRFVTVTAEALRFRQI<br>QREFRQALSETAPVYTMTPEEVDLTLNWGRISNVLPEFRGEG<br>GVRVGRISFNNISAILGTVAVILNCHHQGARSVR |
| SEQ ID NO: 15 | Shiga toxin subtype 2d Subunit A (S1x2dA) variant 3 | REFTIDFSTQQSYVSSLNSIRTEISTPLEHISQGTTSVSVINHTPP<br>GSYFAVDIRGLDVYQARFDHLRLIIEQNNLYVAGFVNTATNTF<br>YRFSDFTHISVPGVTTVSMTTDSSYTTLQRVAALERSGMQISR<br>HSLVSSYLALMEFSGNTMTRDASRAVLRFVTVTAEALRFRQI<br>QREFRQALSETAPVYTMTPGDVDLTLNWGRISNVIPEYRGED<br>GVRVGRISFNNISAILSTVAVILNCHHQGARSVR |

Sequence Listing

| ID Number | Text Description | Biological Sequence |
|---|---|---|
| SEQ ID NO: 16 | Shiga toxin subtype 2e Subunit A (Stx2eA) variant 1 | QEFTIDFSTQQSYVSSLNSIRTAISTPLEHISQGATSVSVINHTPP GSYISVGIRGLDVYQERFDHLRLIIERNNLYVAGFVNTTTNTF YRFSDFAHISLPGVTTISMTTDSSYTTLQRVAALERSGMQISRH SLVSSYLALMEFSGNTMTRDASRAVLRFVTVTAEALRFRQIQ REFRLALSETAPVYTMTPEDVDLTLNWGRISNVLPEYRGEAG VRVGRISFNNISAILGTVAVILNCHHQGARSVR |
| SEQ ID NO: 17 | Shiga toxin subtype 2e Subunit A (Stx2eA) variant 2 | QEFTIDFSTQQSYVSSLNSIRTAISTPLEHISQGATSVSVINHTPP GSYISVGIRGLDVYQAHFDHLRLIIEQNNLYVAGFVNTATNTF YRFSDFAHISLPGVTTISMTTDSSYTTLQRVAALERSGMQISRH SLVSSYLALMEFSGNTMTREASRAVLRFVTVTAEALRFRQIQR EFRQALSETAPVYTMTPEDVDLTLNWGRISNVLPEYRGEDGV RVGRISFNNISAILGTVAVILNCHHQGARSVR |
| SEQ ID NO: 18 | Shiga toxin subtype 2f Subunit A (Stx2fA) | DEFTVDFSSQKSYVDSLNSIRSAISTPLGNISQGGVSVSVINHVP GGNYISLNVRGLDPYSERFNHLRLIMERNNLYVAGFINTETNT FYRFSDFSHISVPDVITVSMTTDSSYSSLQRIADLERTGMQIGR HSLVGSYLDLMEFRGRSMTRASSRAMLRFVTVIAEALRFRQI QRGFRPALSEASPLYTMTAQDVDLTLNWGRISNVLPEYRGEE GVRIGRISFNSLSAILGSVAVILNCHSTGSYSVR |
| SEQ ID NO: 19 | T-cell epitope C1 | VTEHDTLLY |
| SEQ ID NO: 20 | T-cell epitope C1-2 | GLDRNSGNY |
| SEQ ID NO: 21 | T-cell epitope C2 | NLVPMVATV |
| SEQ ID NO: 22 | T-celtepitope C3 | GVMTRGRLK |
| SEQ ID NO: 23 | T-cell epitope C24 | VYALPLKML |
| SEQ ID NO: 24 | T-cell epitope C24-2 | QYDPVAALF |
| SEQ ID NO: 25 | T-cell epitope F2 | GILGFVFTL |
| SEQ ID NO: 26 | T-cell epitope F3 | ILRGSVAHK |
| SEQ ID NO: 27 | T-cell epitope E2 | CLGGLLTMV |
| SEQ ID NO: 28 | T-cell epitope-polypeptide (C2)$_3$ | NLVPMVATVRRNLVPMVATVRRNLVPMVATV |
| SEQ ID NO: 29 | Shiga toxin effector polypeptide SLT-1A-DI-FR | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAA |
| SEQ ID NO: 30 | Shiga toxin effector polypeptide SLT-1A-DI-1 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSFISGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAA |
| SEQ ID NO: 31 | Shiga toxin effector polypeptide SLT-1A-DI-2 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAA |

| Sequence Listing | | |
|---|---|---|
| ID Number | Text Description | Biological Sequence |
| SEQ ID NO: 32 | Shiga toxin effector polypeptide SLT-1A-DI-3 | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSAARAMLRFVTVTAEALRFR QIQRGFRTTLDDLSGASYVMTAEDVDLTLNWGRLSSVLPDYH GQDSVRVGRISFGSINAILGSVALILNSHHASAVAA |
| SEQ ID NO: 33 | Shiga toxin effector polypeptide SLT-1A-DI-4 | KEFTLDFSTAKTYVDSLNVIRSAIGTPLQTISSGGTSLLMIDSGS GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSINAILGSVALILNCHHASAVAA |
| SEQ ID NO: 34 | Shiga toxin effector polypeptide SLT-1A-DI-FRinactive | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTADALRFR QIQRGFRTTLDDLSGRSYVMTAEDVDLTLNWGRLSSVLPDYH GQDSVRVGRISFGSINAILGSVALILNSHHASAVAA |
| SEQ ID NO: 35 | Shiga toxin effector polypeptide SUI-1A-DI-1 inactive | KEFTLDFSTAKTYVDSLNVIRSAIGTPLQTISSGGTSLLMIDSGI GDNLFAVDILGFDFTLGRFNNLRLIVERNNLYVTGFNTNRTNN VFYRFADFSHVTFPGTTAVTLSADSSYTTLQRVAGISRTGMQI NRHSLTTSYLDLMSHSGTSLTQSVARAMLRFVTVTADALRFR QIQRGFRTTLDDLSGASYVMTAEDVDLTLNWGRLSSVLPDYH GQDSVRVGRISFGSINAILGSVALILNSHHASAVAA |
| SEQ ID NO: 36 | Shiga toxin effector polypeptide SLT-1A-DI-2 inactive | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTADALRFR QIQRGFRTTLDDLSGASYVMTAEDVDLTLNWGRISSVLPDYH GQDSVRVGRISFGSINAILGSVALILNSHHASAVAA |
| SEQ ID NO: 37 | Shiga toxin effector poly-peptide SLT-1A-DI-3 inactive | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSAARAMLRFVTVTADALRFR QIQRGFRTTLDDLSGASYVMTAEDVDLTLNWGRLSSVLPDYH GQDSVRVGRISFGSINAILGSVALILNSHHASAVAA |
| SEQ ID NO: 38 | Shiga toxin effector polypeptide SLT-1A-DI-4 inactive | KEFTLDFSTAKTYVDSLNVIRSAIGTPLQTISSGGTSLLMIDSGS GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTADALRFR QIQRGFRTTLDDLSGRSYVMTAEDVDLTLNWGRLSSVLPDYH GQDSVRVGRISFGSINAILGSVALILNCHHASAVAA |
| SEQ ID NO: 39 | light chain ABR1 | QDISNYLA |
| SEQ ID NO: 40 | light chain ABR2 | LLIYYTSILHS |
| SEQ ID NO: 41 | light chain ABR3 | QQGNTLPW |
| SEQ ID NO: 42 | heavy chain ABR1 | YTFTSYWLH |
| SEQ ID NO: 43 | heavy chain ABR2 | WIGYINPRNDYTEY |
| SEQ ID NO: 44 | heavy chain ABR3 | RRDITTFY |
| SEQ ID NO: 45 | light chain ABR1 | QSVLYSANHKNYLA |
| SEQ ID NO: 46 | light chain ABR2 | LLIYWASTRES |

| Sequence Listing | | |
|---|---|---|
| ID Number | Text Description | Biological Sequence |
| SEQ ID NO: 47 | light chain ABR3 | HQYLSSW |
| SEQ ID NO: 48 | heavy chain ABR1 | YEFSRSWMN |
| SEQ ID NO: 49 | heavy chain ABR2 | WVGRIYPGDGDTNYSGKF |
| SEQ ID NO: 50 | heavy chain ABR3 | RDGSSWDWYFDV |
| SEQ ID NO: 51 | light chain ABR1 | QSIVHSVGNTFLE |
| SEQ ID NO: 52 | light chain ABR2 | LLIYKVSNRFS |
| SEQ ID NO: 53 | light chain ABR3 | FQGSQFPY |
| SEQ ID NO: 54 | heavy chain CDR1 | GYRFTNYWIH |
| SEQ ID NO: 55 | heavy chain CDR2 | GINPGNNYATYRRKFQG |
| SEQ ID NO: 56 | heavy chain CDR3 | EGYGNYGAWFAY |
| SEQ ID NO: 57 | light chain CDR1 | RSSQSLANSYGNTFLS |
| SEQ ID NO: 58 | light chain CDR2 | GISNRFS |
| SEQ ID NO: 59 | light chain CDR3 | LQGTHQPYT |
| SEQ ID NO: 60 | heavy chain CDR1 | GFAFSIYDMS |
| SEQ ID NO: 61 | heavy chain CDR2 | YISSGGGTTYYPDTVKG |
| SEQ ID NO: 62 | heavy chain CDR3 | HSGYGTHWGVLFAY |
| SEQ ID NO: 63 | light chain CDR1 | RASQDISNYLA |
| SEQ ID NO: 64 | light chain CDR2 | YTSILHS |
| SEQ ID NO: 65 | light chain CDR3 | QQGNTLPWT |
| SEQ ID NO: 66 | heavy chain CDR1 | GYTFTDYYIT |
| SEQ ID NO: 67 | heavy chain CDR2 | WIYPGSGNTKYNEKF |
| SEQ ID NO: 68 | heavy chain CDR3 | YGNYWFAY |
| SEQ ID NO: 69 | light chain CDR1 | KASQSVDFDGDSYMN |
| SEQ ID NO: 70 | light chain CDR2 | AASNLES |

Sequence Listing

| ID Number | Text Description | Biological Sequence |
|---|---|---|
| SEQ ID NO: 71 | light chain CDR3 | QQSNEDPWT |
| SEQ ID NO: 72 | heavy chain CDR1 | YTFTTYWMH |
| SEQ ID NO: 73 | heavy chain CDR2 | WIGYINPSTGYTDY |
| SEQ ID NO: 74 | heavy chain CDR3 | TRRGPSYGNHGAWFPY |
| SEQ ID NO: 75 | light chain CDR1 | ENVDTYVS |
| SEQ ID NO: 76 | light chain CDR2 | LLIYGASNRYT |
| SEQ ID NO: 77 | light chain CDR3 | GQSYRYPP |
| SEQ ID NO: 78 | heavy chain CDR1 | GYTFTGYYMH |
| SEQ ID NO: 79 | heavy chain CDR2 | WIDPNSGATTYAQKF |
| SEQ ID NO: 80 | heavy chain CDR3 | KTTQTTWGFPF |
| SEQ ID NO: 81 | light chain CDR1 | RASQGVYQWLA |
| SEQ ID NO: 82 | light chain CDR2 | KASHLYN |
| SEQ ID NO: 83 | light chain CDR3 | QQLNSYPLT |
| SEQ ID NO: 84 | heavy chain CDR1 | GYTFTDYWMH |
| SEQ ID NO: 85 | heavy chain CDR2 | WIGYINPNTAYTDY |
| SEQ ID NO: 86 | light chain CDR1 | KASENVDSFVS |
| SEQ ID NO: 87 | light chain CDR2 | GASNRYT |
| SEQ ID NO: 88 | light chain CDR3 | GQNYRYPLT |
| SEQ ID NO: 89 | heavy chain ABR1 | FSLISYGVH |
| SEQ ID NO: 90 | heavy chain ABR2 | WLGVIWRGGSTDY |
| SEQ ID NO: 91 | heavy chain ABR3 | KTLITTGYAMDY |
| SEQ ID NO: 92 | light chain ABR1 | EDIYNRLA |
| SEQ ID NO: 93 | light chain ABR2 | LLISGATSLETG |
| SEQ ID NO: 94 | light chain ABR3 | QQYWSTP |
| SEQ ID NO: 95 | heavy chain ABR1 | FTFNSFAMS |

-continued

Sequence Listing

| ID Number | Text Description | Biological Sequence |
|---|---|---|
| SEQ ID NO: 96 | heavy chain ABR2 | WVSAISGSGGGTYY |
| SEQ ID NO: 97 | heavy chain ABR3 | KDKILWFGEPVFDY |
| SEQ ID NO: 98 | light chain ABR1 | QSVSSYLA |
| SEQ ID NO: 99 | light chain ABR2 | LLIYDASNRAT |
| SEQ ID NO: 100 | light chain ABR3 | QQRSNWPP |
| SEQ ID NO: 101 | heavy chain ABR1 | FSLTSYGVH |
| SEQ ID NO: 102 | heavy chain ABR2 | WIGVMWRGGSTDY |
| SEQ ID NO: 103 | heavy chain ABR3 | KSMITTGFVMDS |
| SEQ ID NO: 104 | light chain ABR1 | EDIYNRLT |
| SEQ ID NO: 105 | light chain ABR2 | LLISGATSLET |
| SEQ ID NO: 106 | light chain ABR3 | QQYWSNPY |
| SEQ ID NO: 107 | heavy chain ABR1 | FDFSRSWMN |
| SEQ ID NO: 108 | heavy chain ABR2 | WIGEINPDSSTINY |
| SEQ ID NO: 109 | heavy chain ABR3 | RYGNWFPY |
| SEQ ID NO: 110 | light chain ABR1 | QNVDTNVA |
| SEQ ID NO: 111 | light chain ABR2 | ALLYSASYRYS |
| SEQ ID NO: 112 | light chain ABR3 | QQYDSYPL |
| SEQ ID NO: 113 | heavy chain ABR1 | GTFSSYAFS |
| SEQ ID NO: 114 | heavy chain ABR2 | WMGRVIPFLGIANS |
| SEQ ID NO: 115 | heavy chain ABR3 | RDDIAALGPFDY |
| SEQ ID NO: 116 | light chain ABR1 | QGISSWLA |
| SEQ ID NO: 117 | light chain ABR2 | SLIYAASSLQS |
| SEQ ID NO: 118 | light chain ABR3 | QQYNSYPR |
| SEQ ID NO: 119 | heavy chain ABR1 | YTFTDYWMQ |

Sequence Listing

| ID Number | Text Description | Biological Sequence |
|---|---|---|
| SEQ ID NO: 120 | heavy chain ABR2 | WIGTIYPGDGDTGY |
| SEQ ID NO: 121 | heavy chain ABR3 | RGDYYGSNSLDY |
| SEQ ID NO: 122 | light chain ABR1 | QDVSTVVA |
| SEQ ID NO: 123 | light chain ABR2 | RHYSASYRYI |
| SEQ ID NO: 124 | light chain ABR3 | QQHYSPPY |
| SEQ ID NO: 125 | heavy chain CDR1 | GFSLTSYGVH |
| SEQ ID NO: 126 | heavy chain CDR2 | VMWRGGSTDYNAAFMS |
| SEQ ID NO: 127 | heavy chain CDR3 | SMITTGFVMDS |
| SEQ ID NO: 128 | light chain CDR1 | KASEDIYNRLT |
| SEQ ID NO: 129 | light chain CDR2 | GATSLET |
| SEQ ID NO: 130 | light chain CDR3 | QQYWSNPYT |
| SEQ ID NO: 131 | heavy chain CDR1 | GFSLISYGVH |
| SEQ ID NO: 132 | heavy chain CDR2 | VIWRGGSTDYNAAFMS |
| SEQ ID NO: 133 | heavy chain CDR3 | TLITTGYAMDY |
| SEQ ID NO: 134 | light chain CDR1 | KASEDIYNRLA |
| SEQ ID NO: 135 | light chain CDR2 | GATSLET |
| SEQ ID NO: 136 | light chain CDR3 | QQYWSTPT |
| SEQ ID NO: 137 | heavy chain CDR1 | GFDFSRSWMN |
| SEQ ID NO: 138 | heavy chain CDR2 | EINPDSSTINYTTSLKD |
| SEQ ID NO: 139 | heavy chain CDR3 | YGNWFPY |
| SEQ ID NO: 140 | light chain CDR1 | KASQNVDTNVA |
| SEQ ID NO: 141 | light chain CDR2 | SASYRYS |
| SEQ ID NO: 142 | light chain CDR3 | QQYDSYPLT |
| SEQ ID NO: 143 | heavy chain ABR1 | FDFSRYWMS |
| SEQ ID NO: 144 | heavy chain ABR2 | WIGEINPTSSTINF |

Sequence Listing

| ID Number | Text Description | Biological Sequence |
|---|---|---|
| SEQ ID NO: 145 | heavy chain ABR3 | RGNYYRYGDAMDY |
| SEQ ID NO: 146 | light chain ABR1 | KSVSTSGYSYLH |
| SEQ ID NO: 147 | light chain ABR2 | LLIYLASNLES |
| SEQ ID NO: 148 | light chain ABR3 | QHSRELPF |
| SEQ ID NO: 149 | heavy chain ABR1 | STFTTYWIH |
| SEQ ID NO: 150 | heavy chain ABR2 | WIGYINPNTGYTEY |
| SEQ ID NO: 151 | heavy chain ABR3 | VRFITVVGG |
| SEQ ID NO: 152 | light chain ABR1 | SSVSSSHLH |
| SEQ ID NO: 153 | light chain ABR2 | LWIYSTSNLAS |
| SEQ ID NO: 154 | light chain ABR3 | HQYHRSPL |
| SEQ ID NO: 155 | heavy chain ABR1 | FSLTTYGIGVG |
| SEQ ID NO: 156 | heavy chain ABR2 | WLTHIWWNDNKYY |
| SEQ ID NO: 157 | heavy chain ABR3 | YGYTY |
| SEQ ID NO: 158 | light chain ABR1 | QSLLYSNGNTYLH |
| SEQ ID NO: 159 | light chain ABR2 | LLIYKLSNRFS |
| SEQ ID NO: 160 | light chain ABR3 | SQSTHVPW |
| SEQ ID NO: 161 | heavy chain ABR1 | FNIKDTYIH |
| SEQ ID NO: 162 | heavy chain ABR2 | WVARIYPTNGYTRY |
| SEQ ID NO: 163 | heavy chain ABR3 | RWGGDGFYAMDY |
| SEQ ID NO: 164 | light chain ABR1 | QDVNTAVA |
| SEQ ID NO: 165 | light chain ABR2 | LLIYSASFLYS |
| SEQ ID NO: 166 | light chain ABR3 | QQHYTTPP |
| SEQ ID NO: 167 | heavy chain ABR3 | RWGGDGFYAMDV |
| SEQ ID NO: 168 | heavy chain ABR1 | YSFTSYWIA |

| Sequence Listing | | |
|---|---|---|
| ID Number | Text Description | Biological Sequence |
| SEQ ID NO: 169 | heavy chain ABR2 | YMGLIYPGDSDTKY |
| SEQ ID NO: 170 | heavy chain ABR3 | RHDVGYCSSSNCAKWPEYFQH |
| SEQ ID NO: 171 | light chain ABR1 | SSNIGNNYVS |
| SEQ ID NO: 172 | light chain ABR2 | LLIYGHTNRPA |
| SEQ ID NO: 173 | light chain ABR3 | AAWDDSLSGW |
| SEQ ID NO: 174 | heavy chain ABR1 | YPFTNYGMN |
| SEQ ID NO: 175 | heavy chain ABR2 | WMGWINTSTGESTF |
| SEQ ID NO: 176 | heavy chain ABR3 | RWEVYHGYVPY |
| SEQ ID NO: 177 | light chain ABR1 | QDVYNAVA |
| SEQ ID NO: 178 | light chain ABR2 | LLIYSASSRYT |
| SEQ ID NO: 179 | light chain ABR3 | QQHFRTPF |
| SEQ ID NO: 180 | heavy chain ABR1 | ITFSINTMG |
| SEQ ID NO: 181 | heavy chain ABR2 | LVALISSIGDTYYA |
| SEQ ID NO: 182 | heavy chain ABR3 | KRFRTAAQGTDY |
| SEQ ID NO: 183 | heavy chain CDR1 | GFNIKDTYIH |
| SEQ ID NO: 184 | heavy chain CDR2 | RIYPTNGYTRYADSVKG |
| SEQ ID NO: 185 | heavy chain CDR3 | WGGDGFYAMDY |
| SEQ ID NO: 186 | light chain CDR1 | RASQDVNTAVA |
| SEQ ID NO: 187 | light chain CDR2 | SASFLYS |
| SEQ ID NO: 188 | light chain CDR3 | QQHYTTPPT |
| SEQ ID NO: 189 | heavy chain CDR1 | GFNIKDTYIH |
| SEQ ID NO: 190 | heavy chain CDR2 | RIYPTNGYTRYADSVKG |
| SEQ ID NO: 191 | heavy chain CDR3 | WGGDGFYAMDV |
| SEQ ID NO: 192 | light chain CDR1 | RASQDVNTAVA |

| | Sequence Listing | |
|---|---|---|
| ID Number | Text Description | Biological Sequence |
| SEQ ID NO: 193 | light chain CDR2 | SASFLYS |
| SEQ ID NO: 194 | light chain CDR3 | QQHYTTPPT |
| SEQ ID NO: 195 | heavy chain CDR1 | GYSFTSYWIA |
| SEQ ID NO: 196 | heavy chain CDR2 | LIYPGDSDTKYSPSFQG |
| SEQ ID NO: 197 | heavy chain CDR3 | HDVGYCSSSNCAKWPEYFQH |
| SEQ ID NO: 198 | light chain CDR1 | SGSSSNIGNNYVS |
| SEQ ID NO: 199 | light chain CDR2 | GHTNRPA |
| SEQ ID NO: 200 | light chain CDR3 | AAWDDSLSGWV |
| SEQ ID NO: 201 | heavy chain CDR1 | GITFSINTMG |
| SEQ ID NO: 202 | heavy chain CDR2 | LISSIGDTYYADSVKG |
| SEQ ID NO: 203 | heavy chain CDR3 | FRTAAQGTDY |
| SEQ ID NO: 204 | heavy chain ABR1 | FIFSDSWIH |
| SEQ ID NO: 205 | heavy chain ABR2 | WVAWISPYGGSTYY |
| SEQ ID NO: 206 | heavy chain ABR3 | RRHWPGGFDY |
| SEQ ID NO: 207 | light chain ABR1 | QDVSTAVA |
| SEQ ID NO: 208 | light chain ABR2 | LLIYSASFLYS |
| SEQ ID NO: 209 | light chain ABR3 | QQYLYHPA |
| SEQ ID NO: 210 | heavy chain ABR1 | YTFTSYVMH |
| SEQ ID NO: 211 | heavy chain ABR2 | WIGYVNPFNDGTKY |
| SEQ ID NO: 212 | heavy chain ABR3 | RQAWGYP |
| SEQ ID NO: 213 | light chain ABR1 | ESVEYYGTSLVQ |
| SEQ ID NO: 214 | light chain ABR2 | LLIYAASSVDS |
| SEQ ID NO: 215 | light chain ABR3 | QQSRRVPY |
| SEQ ID NO: 216 | heavy chain ABR1 | YTFTSYDVH |

-continued

| ID Number | Text Description | Biological Sequence |
|---|---|---|
| SEQ ID NO: 217 | heavy chain ABR2 | WMGWLHADTGITKF |
| SEQ ID NO: 218 | heavy chain ABR3 | RERIQLWFDY |
| SEQ ID NO: 219 | light chain ABR1 | QGISSWLA |
| SEQ ID NO: 220 | light chain ABR2 | SLIYAASSLQS |
| SEQ ID NO: 221 | light chain ABR3 | QQYNSYPY |
| SEQ ID NO: 222 | heavy chain ABR1 | DTFSTYAIS |
| SEQ ID NO: 223 | heavy chain ABR2 | WMGGIIPIFGKAHY |
| SEQ ID NO: 224 | heavy chain ABR3 | RKFHFVSGSPFGMDV |
| SEQ ID NO: 225 | light chain ABR1 | QSVSSYLA |
| SEQ ID NO: 226 | light chain ABR2 | LLIYDASNRAT |
| SEQ ID NO: 227 | light chain ABR3 | QQRSNWP |
| SEQ ID NO: 228 | heavy chain ABR1 | FTFSSYIMM |
| SEQ ID NO: 229 | heavy chain ABR2 | WVSSIYPSGGITFY |
| SEQ ID NO: 230 | heavy chain ABR3 | RIKLGTVTTVDY |
| SEQ ID NO: 231 | light chain ABR1 | SSDVGGYNYVS |
| SEQ ID NO: 232 | light chain ABR2 | LMIYDVSNRPS |
| SEQ ID NO: 233 | light chain ABR3 | SSYTSSSTR |
| SEQ ID NO: 234 | heavy chain CDR1 | GFNIKDYFLH |
| SEQ ID NO: 235 | heavy chain CDR2 | WINPDNGNTVYDPKFQG |
| SEQ ID NO: 236 | heavy chain CDR3 | RDYTYEKAALDY |
| SEQ ID NO: 237 | light chain CDR1 | RASGNIYNYLA |
| SEQ ID NO: 238 | light chain CDR2 | DAKTLAD |
| SEQ ID NO: 239 | light chain CDR3 | QHFWSLPFT |
| SEQ ID NO: 240 | heavy chain CDR1 | YTFTSYVMH |

-continued

Sequence Listing

| ID Number | Text Description | Biological Sequence |
|---|---|---|
| SEQ ID NO: 241 | heavy chain CDR2 | YVNPFNDGTKYNEMF |
| SEQ ID NO: 242 | heavy chain CDR3 | QAWGYP |
| SEQ ID NO: 243 | light chain CDR1 | RATESVEYYGTSLVQ |
| SEQ ID NO: 244 | light chain CDR2 | AASSVDS |
| SEQ ID NO: 245 | light chain CDR3 | QQSRRVPYT |
| SEQ ID NO: 246 | linker 1 | EFPKPSTPPGSSGGAP |
| SEQ ID NO: 247 | linker 1 with extension | EFPKPSTPPGSSGGAPGILGFVFTL |
| SEQ ID NO: 248 | linker 2 | GGGGSGG |
| SEQ ID NO: 249 | linker 3 | GGGGSGGGGSGGGGSGGGGSGGGGS |
| SEQ ID NO: 250 | linker 4 | GSTSGSGKPGSGEGS |
| SEQ ID NO: 251 | linker 5 | GGGGS |
| SEQ ID NO: 252 | exemplary cell-targeting molecule SLTA-1A-DI-FR::scFv1::C2 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSNLVPMVATV |
| SEQ ID NO: 253 | exemplary cell-targeting molecule inactive SLT-1A-DI-4::seFv6::(C2) 3 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTADALR FRQIQRGFRTTLDDLSGRSYVMTAEDVDLTLNWGRLSSVLPD YHGQDSVRVGRISFGSINAILGSVALILNCHHHASAVAAEFPK PSTPPGSSGGAPEVQLVESGGGLVQPGGSLRLSCAASGFTFSD SWIHWVRQAPGKGLEWVAWISPYGGSTYYADSVKGRFTISA DTSKNTAYLQMNSLRAEDTAVYYCARRHWPGGFDYWGQGT LVTVSSGGGGSGGGGSGGGGSGGGGSGGGGSDIQMTQSPSSL SASVGDRVTITCRASQDVSTAVAWYQQKPGKAPKLLIYSASF LYSGVPSRFSGSGSGTDFTLTISSLQPEDFATYYCQQYLYHPAT FGQGTKVEIKNLVPMVATVRRNLVPMVATVRRNLVPMVATV |
| SEQ ID NO: 254 | exemplary cell-targeting molecule inactive SLT-1A-DI-1::sav8::C2 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTADALRF RQIQRGFRTTLDDLSGASYVMTAEDVDLTLNWGRLSSVLPDY HGQDSVRVGRISFGSINAILGSVALILNSHHHASAVAAEFPKPS TPPGSSGGAPDIVLTQSPASLAVSLGQRATISCRATESVEYYGT SLVQWYQQKPGQPPKLLIYAASSVDSGVPARFSGSGSGTDFSL TIHPVEEDDIAMYFCQQSRRVPYTFGGGTKLEIKGGGGSEVQL QQSGPELVKPGASVKMSCKASGYTFTSYVMHWVKQKPGQG LEWIGYVNPFNDGTKYNEMFKGKATLTSDKSSSTAYMELSSL TSEDSAVYYCARQAWGYPWGQGTLVTVSANLVPMVATV |

-continued

Sequence Listing

| ID Number | Text Description | Biological Sequence |
|---|---|---|
| SEQ ID NO: 255 | exemplary cell-targeting molecule SLT-1A-DI-scFv8::C2 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPDIVLTQSPASLAVSLGQRATISCRATESVEYYGTS LVQWYQQKPGQPPKLLIYAASSVDSGVPARFSGSGSGTDFSLT IHPVEEDDIAMYFCQQSRRVPYTFGGGTKLEIKGGGGSEVQLQ QSGPELVKPGASVKMSCKASGYTFTSYVMHWVKQKPGQGLE WIGYVNPFNDGTKYNEMFKGKATLTSDKSSSTAYMELSSLTS EDSAVYYCARQAWGYPWGQGTLVTVSANLVPMVATV |
| SEQ ID NO: 256 | reference cell-targeting molecule 29 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTADALRF RQIQRGFRTTLDDLSGASYVMTAEDVDLTLNWGRLSSVLPDY HGQDSVRVGRISFGSINAILGSVALILNSHHHASAVAAEFPKPS TPPGSSGGAPDIVLTQSPASLAVSLGQRATISCRATESVEYYGT SLVQWYQQKPGQPPKLLIYAASSVDSGVPARFSGSGSGTDFSL TIHPVEEDDIAMYFCQQSRRVPYTFGGGTKLEIKGGGGSEVQL QQSGPELVKPGASVKMSCKASGYTFTSYVMHWVKQKPGQG LEWIGYVNPFNDGTKYNEMFKGKATLTSDKSSSTAYMELSSL TSEDSAVYYCARQAWGYPWGQGTLVTVSA |
| SEQ ID NO: 257 | reference cell-targeting molecule 30 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPDIVLTQSPASLAVSLGQRATISCRATESVEYYGTS LVQWYQQKPGQPPKLLIYAASSVDSGVPARFSGSGSGTDFSLT IHPVEEDDIAMYFCQQSRRVPYTFGGGTKLEIKGGGGSEVQLQ QSGPELVKPGASVKMSCKASGYTFTSYVMHWVKQKPGQGLE WIGYVNPFNDGTKYNEMFKGKATLTSDKSSSTAYMELSSLTS EDSAVYYCARQAWGYPWGQGTLVTVSA |
| SEQ ID NO: 258 | reference cell-targeting molecule SLTA-1A-DI-FR::scFv1 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRLFR QIQRGFRTTLDDLSGRSYVMTAEDVDLTLNWGRLSSVLPDYH GQDSVRVGRISFGSINAILGSVALILNSHHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSA |
| SEQ ID NO: 259 | cell-targeting molecule 1 C1::SLT-1A::scFv1 | MVTEHDTLLYKEFTLDFSTAKTYVDSLNVIRSAIGTPLQTISSG GTSLLMIDSGSGDNLFAVDVRGIDPEEGRFNNLRLIVERNNLY VTGFVNRTNNVFYRFADFSHVTFPGTTAVTLSGDSSYTTLQR VAGISRTGMQINRHSLTTSYLDLMSHSGTSLTQSVARAMLRF VTVTAEALRFRQIQRGFRTTLDDLSGRSYVMTAEDVDLTLNW GRLSSVLPDYHGQDSVRVGRISFGSINAILGSVALILNSHHHAS AVAAEFPKPSTPPGSSGGAPDIQMTQSPSSLSASVGDRVTITCK ASEDIYNRLTWYQQKPGKAPKLLISGATSLETGVPSRFSGSGS GTDFTFTISSLQPEDIATYYCQQYWSNPYTFGQGTKVEIKGGG GSQVQLQESGPGLVRPSQTLSLTCTVSGFSLTSYGVHWVRQPP GRGLEWIGVMWRGGSTDYNAAFMSRLNITKDNSKNQVSLRL SSVTAADTAVYYCAKSMITTGFVMDSWGQGSLVTVSS |
| SEQ ID NO: 260 | cell-targeting molecule 2 C1-2::SLT-1A::scFv1 | MGLDRNSGNYKEFTLDFSTAKTYVDSLNVIRSAIGTPLQTISS GGTSLLMIDSGSGDNLFAVDVRGIDPEEGRFNNLRLIVERNNL YVTGFVNRTNNVFYRFADFSHVTFPGTTAVTLSGDSSYTTLQ RVAGISRTGMQINRHSLTTSYLDLMSHSGTSLTQSVARAMLR FVTVTAEALRFRQIQRGFRTTLDDLSGRSYVMTAEDVDLTLN |

-continued

Sequence Listing

| ID Number | Text Description | Biological Sequence |
|---|---|---|
| | | WGRLSSVLPDYHGQDSVRVGRISFGSINAILGSVALILNSHHH ASAVAAEFPKPSTPPGSSGGAPDIQMTQSPSSLSASVGDRVTIT CKASEDIYNRLTWYQQKPGKAPKLLISGATSLETGVPSRFSGS GSGTDFTFTISSLQPEDIATYYCQQYWSNPYTFGQGTKVEIKG GGGSQVQLQESGPGLVRPSQTLSLTCTVSGFSLTSYGVHWVR QPPGRGLEWIGVMWRGGSTDYNAAFMSRLNITKDNSKNQVS LRLSSVTAADTAVYYCAKSMITTGFVMDSWGQGSLVTVSS |
| SEQ ID NO: 261 | cell-targeting molecule 3 C3::SLT-1A::scFv1 | MGVMTRGRLKEFTLDFSTAKTYVDSLNVIRSAIGTPLQTISSG GTSLLMIDSGSGDNLFAVDVRGIDPEEGRFNNLRLIVERNNLY VTGFVNRTNNVFYRFADFSHVTFPGTTAVTLSGDSSYTTLQR VAGISRTGMQINRHSLTTSYLDLMSHSGTSLTQSVARAMLRF VTVTAEALRFRQIQRGFRTTLDDLSGRSYVMTAEDVDLTLNW GRLSSVLPDYHGQDSVRVGRISFGSINAILGSVALILNSHHHAS AVAAEFTKPSTPPGSSGGAPDIQMTQSPSSLSASVGDWVTITCK ASEDIYNRLTWYQQKPGKAPKLLISGATSLETGVPSRFSGSGS GTDFTFTISSLQPEDIATYYCQQYWSNPYTFGQGTKVEIKGGG GSQVQLQESGPGLVRPSQTLSLTCTVSGFSLTSYGVHWVRQPP GRGLEWIGVMWRGGSTDYNAAFMSRLNITKDNSKNQVSLRL SSVTAADTAVYYCAKSMITTGFVMDSWGQGSLVTVSS |
| SEQ ID NO: 262 | cell-targeting molecule 4 C24::SLT-1A::scFv1 | MVYALPLKMLKEFTLDFSTAKTYVDSLNVIRSAIGTPLQTISS GGTSLLMIDSGSGDNLFAVDVRGIDPEEGRFNNLRLIVERNNL YVTGFVNRTNNVFYRFADFSHVTFPGTTAVELSGDSSYTTLQ RVAGISRTGMQINRHSLTTSYLDLNISHSGTSLTQSVARAMLR FVTVTAEALRFRQIQRGFRTTLDDLSGRSYVMTAEDVDLTLN WGRLSSVLPDYHGQDSVRVGRISFGSINAILGSVALILNSHHH ASAVAAEFPKPSTPPGSSGGAPDIQMTQSPSSLSASVGDRVTIT CKASEDIYNRLTWYQQKPGKAPKLLISGATSLETGVPSRFSGS GSGYDFTFTISSLQPEDIATYYCQQYWSNPYTFGQGTKVEIKG GGGSQVQLQESGPGLVRPSQIESLTCTVSGFSLTSYGVHWVR QPPGRGLEWIGVMWRGGSTDYNAAFMSRLNITKDNSKNQVS LRLSSVTAADTAVYYCAKSMITTGFVMDSWGQGSLVTVSS |
| SEQ ID NO: 263 | cell-targeting molecule 5 SLT-1A::scFv1::C1 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNSHHHASAVAAEFPKPS TPPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VVYCAKSMITTGFVMDSWGQGSLVTVSSVTEHDTLLY |
| SEQ ID NO: 264 | cell-targeting molecule 6 SLT-1A::scFv1::C2 4-2 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNSHHHASAVAAEFPKPS TPPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSQYDPVAALF |
| SEQ ID NO: 265 | cell-targeting molecule 7 SLT-1A::scFv1::E2 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNSHHHASAVAAEFPKPS TPPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSCLGGLLTMV |

-continued

Sequence Listing

| ID Number | Text Description | Biological Sequence |
|---|---|---|
| SEQ ID NO: 266 | cell-targeting molecule 8 SLT-1A::scFv1::F3 | MKEFTLDFSTAKTYVDSLNVIRSAIGTPLQTISSGGTSLLMIDS GSGDNLFAVDVRGIDPEEGRGNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNSHHHASAVAAEFPKPS TPPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSILRGSVAHK |
| SEQ ID NO: 267 | cell-targeting molecule 9 C2::SLT-1A::scFv2 | MNLVPMVATVKEFTLDFSTAKTYVDSLNVIRSAIGTPLQTISS GGTSLLMIDSGSGDNLFAVDVRGIDPEEGRFNNLRLIVERNNL YVTGFVNRTNNVFYRFADFSHVTFPGTTAVTLSGDSSYTTLQ RVAGISRTGMQINRHSLITSYLDLMSHSGTSLTQSVARAMLR FVTVTAEALRFRQIQRGFRTTLDDLSGRSYVMTAEDVDLTLN WGRLSSVLPDYHGQDSVRVGRISFGSINAILGSVALILNCHHH ASAVAAEFPKPSTPPGSSGGAPDIQMTQSPSSLSASVGDRVTIT CKASEDIYNRLTWYQQKPGKAPKLLISGATSLETGVPSRFSGS GSGTDFTFTISSLQPEDIATYYCQQYWSNPYTFGQGTKVEIKG STSGSGKPGSGEGSTKGQVQLQESGPGLVRPSQTLSLTCTVSG FSLTSYGVHWVRQPPGRGLEWIGVMWRGGSTDYNAAFMSRL NITKDNSKNQVSLRLSSVTAADTAVYYCAKSMITTGFVMDS WGQGSLVTVSS |
| SEQ ID NO: 268 | cell-targeting molecule 10 inactive C2::SLT-1A::scFv2 | MNLVPMVATVKEFTLDFSTAKTYVDSLNVIRSAIGTPLQTISS GGTSLLMIDSGSGDNLFAVDVRGIDPEEGRFNNLRLIVERNNL YVTGFVNRTNNVFYRFADFSHVTFPGTTAVTLSGDSSYTTLQ RVAGISRTGMQINRHSLTTSYLDLMSHSGTSLTQSVARAMLR FVTVTADALRFRQIQRGFRTTLDDLSGRSYVMTAEDVDLTLN WGRLSSVLPDYHGQDSVRVGRISFGSINAILGSVALILNCHHH ASAVAAEFPKPSTPPGSSGGAPDIQMTQSPSSLSASVGDRVTIT CKASEDIYNRLTWYQQKPGKAPKLLISGATSLETGVPSRFSGS GSGTDFTFTISSLQPEDIATYYCQQYWSNPYTFGQGTKVEIKG STSGSGKPGSGEGSTKGQVQLQESGPGLVRPSQTLSLTCTVSG FSLTSYGVHWVRQPPGRGLEWIGVMWRGGSTDYNAAFMSRL NITKDNSKNQVSLRLSSVTAADTAVYYCAKSMITTGFVMDS WGQGSLVTVSS |
| SEQ ID NO: 269 | cell-targeting molecule 11 SLT-1A::scFv2::C2 | MKEFTLDFSTAKTYVDSLNVIRSAIGTPLQTISSGGTSLLMIDS GSGDNLFAVDVRGIDPEEGRFNNLRLIVERNNLYNTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGSTSGSGKPGSGE GSTKGQVQLQESGPGLVRPSQTLSLTCTVSGFSLTSYGVHWV RQPPGRGLEWIGVMWRGGSTDYNAAFMSRLNITKDNSKNQV SLRLSSVTAADTAVYYCAKSMITTGFVMDSWGQGSLVTVSSN LVPMVATV |
| SEQ ID NO: 270 | cell-targeting molecule 12 inactive SLT-1A::scFv2::C2 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTADALR FRQIQRGFRTTLDDLSGRSYVMTAEDVDLTLNWGRLSSVLPD YHGQDSVRVGRISFGSINAILGSVALILNCHHHASAVAAEFPK PSTPPGSSGGAPDIQMTQSPSSLSASVGDRVTITCKASEDIYNR LTWYQQKPGKAPKLLISGATSLETGVPSRFSGSGSGTDFTFTIS SLQPEDIATYYCQQYWSNPYTFGQGTKVEIKGSTSGSGKPGSG EGSTKGQVQLQESGPGLVRPSQTLSLTCTVSGFSLTSYGVHW VRQPPGRGLEWIGVMWRGGSTDYNAAFMSRLNITKDNSKNQ VSLRLSSVTAADTAVYYCAKSMITTGFVMDSWGQGSLVTVSS NLVPMVATV |

-continued

| Sequence Listing | | |
|---|---|---|
| ID Number | Text Description | Biological Sequence |
| SEQ ID NO: 271 | cell-targeting molecule 13 F2:: SLT-1A::scFv2 | MGILGFVFTLKEFTLDFSTAKTYVDSLNVIRSAIGTPLQTISSG GTSLLMIDSGSGDNLFAVDVRGIDPEEGRFNNLRLIVERNNLY VTGFVNRTNNVFYRFADFSHVTFPGTTAVTLSGDSSYTTLQR VAGISRTGMQINRHSLTTSYLDLMSHSGTSLTQSVARAMLRF VTVTAEALRFRQIQRGFRTTLDDLSGRSYVMTAEDVDLTLNW GRLSSVLPDYHGQDSVRVGRISFGSINAILGSVALILNCHHHAS AVAAEFPKPSTPPGSSGGAPDIQMTQSPSSLSASVGDRVMCK ASEDIYNRLTWYQQKPGKAPKLLISGATSLETGVPSRFSGSGS GTDFTFTISSLQPEDIATYYCQQYWSNPYTFGQGTKVEIKGSTS GSGKPGSGEGSTKGQVQLQESGPGLVRPSQTLSLTCTVSGFSL TSYGVHWVRQPPGRGLEWIGVMWRGGSTDYNAAFMSRLNIT KDNSKNQVSLRLSSVTAADTAVYYCAKSMITTGFVMDSWGQ GSINTVSS |
| SEQ ID NO: 272 | cell-targeting molecule 14 scFv3::F2::SLT-1A | MDIQMTQSPSSLSASVGDRVTITCRASQDVNTAVAWYQQKP GKAPKLLIYSASFLYSGVPSRFSGSRSGTDFTLTISSLQPEDFAT YYCQQHYTTPPTFGQGTKVEIKRTGSTSGSGKPGSGEGSEVQL VESGGGLVQPGGSLRLSCAASGFNIKDTYIHWVRQAPGKGEE WVARIYPTNGYTRYADSVKGRFTISADTSKNTAYLQMNSLRA EDTAVYYCSRWGGDGFYAMDVWGQGTLVTVSSEFPKPSTPP GSSGGAPGILGFVFTLKEFTLDFSTAKTYVDSLNVIRSAIGTPL QTISSGGTSLLMIDSGSGDNLFAVDVRGIDPEEGRFNNLRLIVE RNNLYVTGFVNRTNNVFYRFADFSHVTFPGTTAVTLSGDSSY TTLQRVAGISRTGMQINRHSLTTSYLDLMSHSGTSLTQSVARA MLRFVTVTAEALRFRQIQRGFRTTLDDLSGRSYVMTAEDVDL TLNWGRLSSVLPDYHGQDSVRVGRISFGSINAILGSVALILNC HHHASRVAR |
| SEQ ID NO: 273 | cell-targeting molecule 15 scFv4::F2::SLT-1A | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLKEFTLDFSTAKTYVDSLNVIRSAIGTP LQTISSGGTSLLMIDSGSGDNLFAVDVRGIDPEEGRFNNLRLIV ERNNLYVTGFVNRTNNVFYRFADFSHVTFPGTTAVTLSGDSS YTTLQRVAGISRTGMQINRHSLTTSYLDLMSHSGTSLTQSVAR AMLRGVTVTAEALRFRQIQRGFRTTLDDLSGRSYVMTAEDVD LTLNWGRLSSVLPDYHGQDSVRVGRISFGSINAILGSVALILNC HHHASRVAR |
| SEQ ID NO: 274 | cell-targeting molecule 16 SLT-1A::scFv5::C2 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPDIQMTQSPSSLSASVGDRVTITCRASQDVNTAV AWYQQKPGKAPKLLIYSASFLYSGVPSRFSGSRSGTDFTLTISS LQPEDFATYYCQQHYTTPPTFGQGTKVEIKGGGGSEVQLVES GGGLVQPGGSLRLSCAASGFNIKDTYIHWVRQAPGKGLEWV ARIYPTNGYTRYADSVKGRFTISADTSKNTAYLQMNSLRAED TAVYYCSRWGGDGFYAMDYWGQGTLVTVSSNLVPMVATV |
| SEQ ID NO: 275 | cell-targeting molecule 17 SLT-1A::scFv6::F2 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALIENCHHHASAVAAEFPKPS TPPGSSGGAPEVQLVESGGGLVQPGGSLRLSCAASGFTFSDSW IHWVRQAPGKGLEWVAWISPYGGSTYYADSVKGRFTISADTS KNTAYLQMNSLRAEDTAVYYCARRHWPGGFDYWGQGTLVT VSSGGGGSGGGGSGGGGSGGGGSGGGGSDIQMTQSPSSLSAS VGDRVTITCRASQDVSTAVAWYQQKPGKAPKLLIYSASFLYS GVPSRFSGSGSGTDFTLTISSLQPEDFATYYCQQYLYHPATFG QGTKVEIKGILGFVFTL |
| SEQ ID NO: 276 | cell-targeting molecule 18 inactive SLT-1A::scFv6::F2 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTADALR FRQIQRGFRTTLDDLSGRSYVMTAEDVDLTLNWGRLSSVLPD |

-continued

Sequence Listing

| ID Number | Text Description | Biological Sequence |
|---|---|---|
| | | YHGQDSVRVGRISFGSINAILGSVALILNCHHHASAVAAEFPK PSTPPGSSGGAPEVQLVESGGGLVQPGGSLRLSCAASGFTFSD SWIHWVRQAPGKGLEWVAWISPYGGSTYYADSVKGRFTISA DTSKNTAYLQMNSLRAEDTAVYYCARRHWPGGFDYWGQGT LVTVSSGGGGSGGGGSGGGGSGGGGSGGGGSDIQMTQSPSSL SASVGDRVTITCRASQDVSTAVAWYQQKPGKAPKLLIYSASF LYSGVPSRFSGSGSGTDFTLTISSLQPEDFATYYCQQYLYHPAT FGQGTKVEIKGILGFVFTL |
| SEQ ID NO: 277 | cell-targeting molecule 19 SLT-1A::scFv7::C2 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPDIQMTQSPSSLSASVGDRVTITCRASQGISSWLA WYQQKPEKAPKSLIYAASSLQSGVPSRFSGSGSGTDFTLTISSL QPEDFATYYCQQYNSYPYTFGQGTKLEIKGGGGSQVQLVQSG AEVKKPGASVKVSCKASGYTFTSYDVHWVRQAPGQRLEWM GWLHADTGITKFSQKFQGRVTITRDTSASTAYMELSSLRSEDT AVYYCARERIQLWFDYWGQGTLVTVSSNLVPMVATV |
| SEQ ID NO: 278 | cell-targeting molecule 20 SLT-1A::scFv1::C2 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSNLVPMVATV |
| SEQ ID NO: 279 | wild-type Shiga toxin effector polypeptide (SLT-1A-WT) | KEFTLDFSTAKTYVDSLNVIRSAIGTPLQTISSGGTSLLMIDSGS GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSINAILGSVALILNCHHHASRVAR |
| SEQ ID NO: 280 | reference cell-targeting molecule 21 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSS |
| SEQ ID NO: 281 | reference cell-targeting molecule 22 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPDIQMTQSPSSLSASVGDRVTITCKASEDIYNRLT WYQQKPGKAPKILISGATSLETGVPSRFSGSGSGTDFTFTISSL QPEDIATYYCQQYWSNPYTFGQGTKVEIKGSTSGSGKPGSGE GSTKGQVQLQESGPGLVRPSQTLSLTCTVSGFSLTSYGVHWV RQPPGRGLEWIGVMWRGGSTDYNAAFMSRLNITKDNSKNQV SLRLSSVTAADTAVYYCAKSMITTGFVMDSWGQGSLVTVSS |
| SEQ ID NO: 282 | reference cell-targeting molecule 23 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTADALR FRQIQRGFRTTLDDLSGRSYVMTAEDVDLTLNWGRLSSVLPD YHGQDSVRVGRISFGSINAILGSVALILNCHHHASAVAAEFPK |

Sequence Listing

| ID Number | Text Description | Biological Sequence |
|---|---|---|
| | | PSTPPGSSGGAPDIQMTQSPSSLSASVGDRVTITCKASEDIYNR<br>LTWYQQKPGKAPKLLISGATSLETGVPSRFSGSGSGTDFTFTIS<br>SLQPEDIATYYCQQYWSNPYTFGQGTKVEIKGSTSGSGKPGSG<br>EGSTKGQVQLQESGPGLVRPSQTLSLTCTVSGFSLTSYGVHW<br>VRQPPGRGLEWIGVMWRGGSTDYNAAFMSRLNITKDNSKNQ<br>VSLRLSSVTAADTAVYYCAKSMITTGFVMDSWGQGSLVTVSS |
| SEQ ID NO: 283 | reference cell-targeting molecule 24 | MKEFTLDFSTAKTYVDSLNVIRSAIGTPLQTISSGGTSLLMIDS<br>GSGDNLFAVDVRGIDPEEGRFNNLRLIVERNNLYVTGFVNRT<br>NNVFYRFADFSHVTFPGTTAVTLSGDSSYTTLQRVAGISRTGM<br>QINRHSLTTSYLDLMSHSGTSLTQSVARAMLRFVTVTAEALRF<br>RQIQRGFRTTLDDLSGRSYVMTAEDVDLTLNWGRLSSVLPDY<br>HGQDSVRVGRISFGSINAILGSVALILNCHHHASAVAAEFPKPS<br>TPPGSSGGAPDIQMTQSPSSLSASVGDRVTITCRASQDVNTAV<br>AWYQQKPGKAPKLLIYSASFLYSGVPSRFSGSRSGTDFTLTISS<br>LQPEDFATYYCQQHYTTPPTFGQGTKVEIKGGGGSEVQLVES<br>GGGLVQPGGSLRLSCAASGFNIKDTYIHWVRQAPGKGLEWV<br>ARIYPTNGYTRYADSVKGRFTISADTSKNTAYLQMNSLRAED<br>TAVYYCSRWGGDGFYAMDYWGQGTLVTVSS |
| SEQ ID NO: 284 | reference cell-targeting molecule 25 | MKEFTLDFSTAKTYVDSLNVIRSAIGTPLQTISSGGTSLLMIDS<br>GSGDNLFAVDVRGIDPEEGRFNNLRLIVERNNLYVTGFVNRT<br>NNVFYRFADFSHVTFPGTTAVTLSGDSSYTTLQRVAGISRTGM<br>QINRHSLTTSYLDLMSHSGTSLTQSVARAMLRFVTVTAEALRF<br>RQIQRGFRTTLDDLSGRSYVMTAEDVDLTLNWGRLSSVLPDY<br>HGQDSVRVGRISFGSINAILGSVALILNCHHHASAVAAEFPKPS<br>TPPGSSGGAPEVQLVESGGGLVQPGGSLRLSCAASGFTFSDSW<br>IHWVRQAPGKGLEWVAWISPYGGSTYYADSVKGRFTISADTS<br>KNTAYLQMNSLRAEDTAVYYCARRHWPGGFDYWGQGTLVT<br>VSSGGGGSGGGGSGGGGSGGGGSGGGGSDIQMTQSPSSLSAS<br>VGDRVTITCRASQDVSTAVAWYQQKPGKAPKLLIYSASFLYS<br>GVPSRFSGSGSGTDFTLTISSLQPEDFATYYCQQYLYHPATFG<br>QGTKVEIK |
| SEQ ID NO: 285 | reference cell-targeting molecule 26 | MKEFTLDFSTAKTYVDSLNVIRSAIGTPLQTISSGGTSLLMIDS<br>GSGDNLFAVDVRGIDPEEGRFNNLRLIVERNNLYVTGFVNRT<br>NNVFYRFADFSHVTFPGTTAVTLSGDSSYTTLQRVAGISRTGM<br>QINRHSLTTSYLDLMSHSGTSLTQSVARAMLRFVTVTADALR<br>FRQIQRGFRTTLDDLSGRSYVMTAEDVDLTLNWGRLSSVLPD<br>YHGQDSVRVGRISFGSINAILGSVALILNCHHHASAVAAEFPK<br>PSTPPGSSGGAPEVQLVESGGGLVQPGGSLRLSCAASGFTFSD<br>SWIHWVRQAPGKGLEWVAWISPYGGSTYYADSVKGRFTISA<br>DTSKNTAYLQMNSLRAEDTAVYYCARRHWPGGFDYWGQGT<br>LVTVSSGGGGSGGGGSGGGGSGGGGSGGGGSDIQMTQSPSSL<br>SASVGDRVTITCRASQDVSTAVAWYQQKPGKAPKLLIYSASF<br>LYSGVPSRFSGSGSGTDFTLTISSLQPEDFATYYCQQYLYHPAT<br>FGQGTKVEIK |
| SEQ ID NO: 286 | reference cell-targeting molecule 27 | MKEFTLDFSTAKTYVDSLNVIRSAIGTPLQTISSGGTSLLMIDS<br>GSGDNLFAVDVRGIDPEEGRFNNLRLIVERNNLYVTGFVNRT<br>NNVFYRFADFSHVTFPGTTAVTLSGDSSYTTLQRVAGISRTGM<br>QINRHSLTTSYLDLMSHSGTSLTQSVARAMLRFVTVTAEALRF<br>RQIQRGFRTTLDDLSGRSYVMTAEDVDLTLNWGRLSSVLPDY<br>HGQDSVRVGRISFGSINAILGSVALILNCHHHASAVAAEFPKPS<br>TPPGSSGGAPDIQMTQSPSSLSASVGDRVTITCRASQGISSWLA<br>WYQQKPEKAPKSLIYAASSLQSGVPSRFSGSGSGTDFTLTISSL<br>QPEDFATYYCQQYNSYPYTFGQGTKLEIKGGGGSQVQLVQSG<br>AEVKKPGASVKVSCKASGYTFTSYDVHWVRQAPGQRLEWM<br>GWLHADTGFFKFSQKFQGRVTITRDTSASTAYMELSSLRSEDT<br>AVYYCARERIQLWFDYWGQGTLVTVSS |
| SEQ ID NO: 287 | reference cell-targeting molecule 28 | MKEFTLDFSTAKTYVDSLNVIRSAIGTPLQTISSGGTSLLMIDS<br>GSGDNLFAVDVRGIDPEEGRFNNLRLIVERNNLYNTGFVNRT<br>NNVFYRFADFSHVTFPGTTAVTLSGDSSYTTLQRVAGISRTGM<br>QINRHSLTTSYLDLMSHSGTSLTQSVARAMLRFVTVTAEALRF<br>RQIQRGFRTTLDDLSGRSYVMTAEDVDLTLNWGRLSSVLPDY<br>HGQDSVRVGRISFGSINAILGSVALILNCHHHASAVAAEFPKPS<br>TPPGSSGGAPGILGFVFTLMQVQLQQPGAELVKPGASVKMSC<br>KTSGYTFTSYNVHWVKQTPGQGLEWIGAIYPGNGDTSFNQKF<br>KGKATLTADKSSSTVYMQLSSLTSEDSAVYYCARSNYYGSSY<br>VWFFDVWGAGTTVTVSSGSTSGSGKPGSGEGSQIVLSQSPTIL<br>SASPGEKVTMTCRASSSVSYMDWYQQKPGSSPKPWIYATSNL<br>ASGVPARFSGSGSGTSYSLTISRVEAEDAATYYCQQWISNPPT<br>FGAGTKLELK |

Sequence Listing

| ID Number | Text Description | Biological Sequence |
|---|---|---|
| SEQ ID NO: 288 | exemplary cell-targeting molecule 1 | VTEHDTLLYAEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSATSLTQSVARAMLRFVTV TAEALRFRQIQRGFRTTLDDLSGRSYVMTAEDVDLTLNWGRL SSVLPDYHGQDSVRVGRISFGSINAILGSVALILNSHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 289 | exemplary cell-targeting molecule 2 | GLDRNSGNYAEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSATSLTQSVARAMLRFVTV TAEALRFRQIQRGFRTTLDDLSGRSYVMTAEDVDLTLNWGRL SSVLPDYHGQDSVRVGRISFGSINAILGSVALILNSHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 290 | exemplary cell-targeting molecule 3 | GVMTRGRLAEFTLDFSTAKTYVDSLNVIRSAIGTPLQTISSGGT SLLMIDSGIGDNLFAVDILGFDFTLGRFNNLRLIVERNNLYVTG FVNRTNNVFYRFADFSHVTFPGTTAVTLSADSSYTTLQRVAGI SRTGMQINRHSLTTSYLDLMSHSATSLTQSVARAMLRFVTVT AEALRFRQIQRGFRTTLDDLSGRSYVMTAEDVDLTLNWGRLS SVLPDYHGQDSVRVGRISFGSINAILGSVALILNSHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 291 | exemplary cell-targeting molecule 4 | VYALPLKMLAEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSATSLTQSVARAMLRFVTV TAEALRFRQIQRGFRTTLDDLSGRSYVMTAEDVDLTLNWGRL SSVLPDYHGQDSVRVGRISFGSINAILGSVALILNSHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 292 | exemplary cell-targeting molecule 5 | NLVPMVATVAEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGITAVTLSADSSYTTLQRVA GISRTGMQINRHSLTTSYLDLMSHSATSLTQSVARAMLRFVTV TAEALRFRQIQRGFRTTLDDLSGRSYVMTAEDVDLTLNWGRL SSVLPDYHGQDSVRVGRISFGSINAILGSVALILNSHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGSTSGSG KPGSGEGSTKGQVQLQESGPGLVRPSQTLSLTCTVSGFSLTSY GVHWVRQPPGRGLEWIGVMWRGGSTDYNAAFMSRLNITKD NSKNQVSLRLSSVTAADTAVYYCAKSMITTGFVMDSWGQGS LVTVSS |
| SEQ ID NO: 293 | exemplary cell-targeting molecule 6 | GILGFVFTLAEFTLDFSTAKTYVDSLNVIRSAIGTPLQTISSGGT SLLMIDSGIGDNLFAVDILGFDFTLGRFNNLRLIVERNNLYVTG FVNRTNNVFYRFADFSHVTFPGTTAVTLSADSSYTTLQRVAGI SRTGMQINRHSLTTSYLDLMSHSATSLTQSVARAMLRFVTVT AEALRFRQIQRGFRTTLDDLSGRSYVMTAEDVDLTLNWGRLS SVLPDYHGQDSVRVGRISFGSINAILGSVALILNSHHASAVA AEFPKPSTPPGSSGGAPDIQMTQSPSSLSASVGDRVTITCKASE |

| ID Number | Text Description | Biological Sequence |
|---|---|---|
| | | DIYNRLTWYQQKPGKAPKLLISGATSLETGVPSRFSGSGSGTD<br>FTFTISSLQPEDIATYYCQQYWSNPYTFGQGTKVEIKGSTSGSG<br>KPGSGEGSTKGQVQLQESGPGLVRPSQTLSLTCTVSGFSLTSY<br>GVHWVRQPPGRGLEWIGVMWRGGSTDYNAAFMSRLNITKD<br>NSKNQVSLRLSSVTAADTAVYYCAKSMITTGFVMDSWGQGS<br>LVTVS |
| SEQ ID NO: 294 | exemplary cell-targeting molecule 7 | DIQMTQSPSSLSASVGDRVTITCRASQDVNTAVAWYQQKPG<br>APKLLIYSASFLYSGVPSRFSGSRSGTDFTLTISSLQPEDFATYY<br>CQQHYTTPPTFGQGTKVEIKRTGSTSGSGKPGSGEGSEVQLVE<br>SGGGLVQPGGSLRLSCAASGFNIKDTYIHWVRQAPGKGLEWV<br>ARIYPTNGYTRYADSVKGRFTISADTSKNTAYLQMNSLRAED<br>TAVYYCSRWGGDGFYAMDVWGQGTLVTVSSEFPKPSTPPGS<br>SGGAPGILGFVFTLAEFTLDFSTAKTYVDSLNVIRSAIGTPLQTI<br>SSGGTSLLMIDSGIGDNLFAVDILGFDFTLGRFNNLRLIVERNN<br>LYVTGFVNRTNNVFYRFADFSHVTFPGTTAVTLSADSSYTTL<br>QRVAGISRTGMQINRHSLTTSYLDLMSHSATSLTQSVARAML<br>RFVTVTAEALRFRQIQRGFRTTLDDLSGRSYVMTAEDVDLTL<br>NWGRLSSVLPDYHGQDSVRVGRISFGSINAILGSVALILNSHH<br>HASAVAA |
| SEQ ID NO: 295 | exemplary cell-targeting molecule 8 | QVQLQQPGAELVKPGASVKMSCKTSGYTFTSYNVHWVKQTP<br>GQGLEWIGAIYPGNGDTSFNQKFKGKATLTADKSSSTVYMQL<br>SSLTSEDSAVYYCARSNYYGSSYVWFFDVWGAGTTVTVSSGS<br>TSGSGKPGSGEGSQIVLSQSPTILSASPGEKVTMTCRASSSVSY<br>MDWYQQKPGSSPKPWIYATSNLASGVPARFSGSGSGTSYSLTI<br>SRVEAEDAATYYCQQWISNPPTFGAGTKLELKEFPKPSTPPGS<br>SGGAPGILGFVFTLAEFTLDFSTAKTYVDSLNVIRSAIGTPLQTI<br>SSGGTSLLMIDSGIGDNLFAVDILGFDFTLGRFNNLRLIVERNN<br>LYVTGFVNRTNNVFYRFADFSHVTFPGTTAVTLSADSSYTTL<br>QRVAGISRTGMQINRHSLTTSYLDLMSHSATSLTQSVARAML<br>RFVTVTAEALRFRQIQRGFRTTLDDLSGRSYVMTAEDVDLTL<br>NWGRLSSVLPDYHGQDSVRVGRISFGSINAILGSVALILNSHH<br>HASAVAA |
| SEQ ID NO: 296 | exemplary cell-targeting molecule 9 | AEFTLDFSTAKTYVDSLNVIRSAIGTPLQTISSGGTSLLMIDSGI<br>GDNLFAVDILGFDFTLGRFNNLRLIVERNNLYVTGFVNRTNN<br>VFYRFADFSHVTFPGTTAVTLSADSSYTTLQRVAGISRTGMQI<br>NRHSLTTSYLDLMSHSATSLTQSVARAMLRFVTVTAEALRFR<br>QIQRGFRTTLDDLSGRSYVMTAEDVDLTLNWGRLSSVLPDYH<br>GQDSVRVGRISFGSINAILGSVALILNSHHHASAVAAEFPKPST<br>PPGSSGGAPDIQMTQSPSSLSASVGDRVTITCKASEDIYNRLT<br>WYQQKPGKAPKLLISGATSLETGVPSRFSGSGSGTDFTFTISSL<br>QPEDIATYYCQQYWSNPYTFGQGTKVEIKGGGGSQVQLQESG<br>PGLVRPSQTLSLTCTVSGFSLTSYGVHWVRQPPGRGLEWIGV<br>MWRGGSTDYNAAFMSRLNITKDNSKNQVSLRLSSVTAADTA<br>VYYCAKSMITTGFVMDSWGQGSLVTVSSVTEHDTLLY |
| SEQ ID NO: 297 | exemplary cell-targeting molecule 10 | AEFTLDFSTAKTYVDSLNVIRSAIGTPLQTISSGGTSLLMIDSGI<br>GDNLFAVDILGFDFTLGRFNNLRLIVERNNLYVTGFVNRTNN<br>VFYRFADFSHVTFPGTTAVTLSADSSYTTLQRVAGISRTGMQI<br>NRHSLTTSYLDLMSHSATSLTQSVARAMLRFVTVTAEALRFR<br>QIQRGFRTTLDDLSGRSYVMTAEDVDLTLNWGRLSSVLPDYH<br>GQDSVRVGRISFGSINAILGSVALILNSHHHASAVAAEFPKPST<br>PPGSSGGAPDIQMTQSPSSLSASVGDRVIITCKASEDIYNRLT<br>WYQQKPGKAPKLLISGATSLETGVPSRFSGSGSGTDFTFTISSL<br>QPEDIATYYCQQYWSNPYTFGQGTKVEIKGGGGSQVQLQESG<br>PGLVRPSQTLSLTCTVSGFSLTSYGVHWVRQPPGRGLEWIGV<br>MWRGGSTDYNAAFMSRLNITKDNSKNQVSLRLSSVTAADTA<br>VYYCAKSMITTGFVMDSWGQGSLVTVSSNLVPMVATV |
| SEQ ID NO: 298 | exemplary cell-targeting molecule 11 | AEFTLDFSTAKTYVDSLNVIRSAIGTPLQTISSGGTSLLMIDSGI<br>GDNLFAVIDILGFDFTLGRFNNLRLIVERNNLYVTGFVNRTNN<br>VFYRFADFSHVTFPGTTAVTLSADSSYTTLQRVAGISRTGMQI<br>NRHSLTTSYLDLMSHSATSLTQSVARAMLRFVTVTAEALRFR<br>QIQRGFRTTLDDLSGRSYVMTAEDVDLTLNWGRLSSVLPDYH<br>GQDSVRVGRISFGSINAILGSVALILNSHHHASAVAAEFTKPST<br>PPGSSGGAPDIQMTQSPSSLSASVGDRVTITCKASEDIYNRLT<br>WYQQKPGKAPKLLISGATSLETGVPSRFSGSGSGTDFTFTISSL<br>QPEDIATYYCQQYWSNPYTFGQGTKVEIKGGGGSQVQLQESG<br>PGLVRPSQTLSLTCTVSGFSLTSYGVHWVRQPPGRGLEWIGV<br>MWRGGSTDYNAAFMSRLNITKDNSKNQVSLRLSSVTAADTA<br>VYYCAKSMITTGFVMDSWGQGSLVTVSSQYDPVAALF |

| Sequence Listing | | |
|---|---|---|
| ID Number | Text Description | Biological Sequence |
| SEQ ID NO: 299 | exemplary cell-targeting molecule 12 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSCLGGLLTMV |
| SEQ ID NO: 300 | exemplary cell-targeting molecule 13 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTIFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSILRGSVAHK |
| SEQ ID NO: 301 | exemplary cell-targeting molecule 14 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMILRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGSTSGSGKPGSGE GSTKGQVQLQESGPGLVRPSQTLSLTCTVSGFSLTSYGVHWV RQPPGRGLEWIGVMWRGGSTDYNAAFMSRLNITKDNSKNQV SLRLSSVTAADTAVYYCAKSMITTGFVMDSWGQGSLVTVSSN LVPMVATV |
| SEQ ID NO: 302 | exemplary cell-targeting molecule 15 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCRASQDVNTAVA WYQQKPGKAPKLLIYSASFLYSGVPSRFSGSRSGTDFTLTISSL QPEDFATYYCQQHYTTPPTFGQGTKVEIKGGGGSEVQLVESG GGLVQPGGSLRLSCAASGFNIKDTYIHWVRQAPGKGLEWVA RIYPTNGYTRYADSVKGRFTISADTSKNTAYLQMNSLRAEDT AVYYCSRWGGDGFYAMDYWGQGTLVTVSSNLVPMVATV |
| SEQ ID NO: 303 | exemplary cell-targeting molecule 16 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPEVQLVESGGGLVQPGGSLRLSCAASGFTFSDSWI HWVRQAPGKGLEWVAWISPYGGSTYYADSVKGRFTISADTS KNTAYLQMNSLRAEDTAVYYCARRHWPGGFDYWGQGTLVT VSSGGGGSGGGGSGGGGSGGGGSGGGGSDIQMTQSPSSLSAS VGDRVTITCRASQDVSTAVAWYQQKPGKAPKLLIYSASFLYS GVPSRFSGSGSGTDFTLTISSLQPEDFATYYCQQYLYHPATFG QGTKVEIKGILGFVFTL |
| SEQ ID NO: 304 | exemplary cell-targeting molecule 17 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCRASQGISSWLA |

| ID Number | Text Description | Biological Sequence |
|---|---|---|
| | | WYQQKPEKAPKSLIYAASSLQSGVPSRFSGSGSGTDFTLTISSL QPEDFATYYCQQYNSYPYTFGQGTKLEIKGGGGSQVQLVQSG AEVKKPGASVKVSCKASGYTFTSYDVHWVRQAPGQRLEWM GWLHADTGITKFSQKFQGRVTITRDTSASTAYMELSSLRSEDT AVYYCARERIQLWFDYWGQGTLVTVSSNLVPMVATV |
| SEQ ID NO: 305 | exemplary cell-targeting molecule 18 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITRDNSKNQVSLRLSSVTAADTA VYYCAKSMITTGFVMDSWGQGSLVTVSSNLVPMVATV |
| SEQ ID NO: 306 | exemplary cell-targeting molecule 19 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPQVQLQQPGAELVKPGASVKMSCKTSGYTFTSYN VHWVKQTPGQGLEWIGAIYPGNGDTSFNQKFKGKATLTADK SSSTVYMQLSSLTSEDSAVYYCARSNYYGSSYVWFFDVWGA GTTVTVSSGSTSGSGKPGSGEGSQIVLSQSPTILSASPGEKVTM TCRASSSVSYMDWYQQKPGSSPKPWTYATSNLASGVPARFSG SGSGTSYSLTISRVEAEDAATYYCQQWISNPPTFGAGTKLELK NLVPMVATV |
| SEQ ID NO: 307 | exemplary cell-targeting molecule 20 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPQVQLVQSGAELVKPGASVKMSCKASGYTFTSYN MHWVKQTPGQGLEWIGAIYPGNGDTSYNQKFKGKATLTADK SSSTAYMQLSSLTSEDSAVYYCATAQLRPNYWYFDVWGAGT TVTVSSGGGGSDIVLSQSPAILSASPGEKVTMTCRASSSVSYM HWYQQKPGSSPKPWIYATSNLASGVPARFSGSGSGTSYSLTIS RVEAEDAATYYCQQWISNPPTFGAGTKLELKNLVPMVATV |
| SEQ ID NO: 308 | exemplary cell-targeting molecule 21 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPQVQLQQPGAELVKPGASVKMSCKASGYTFTSYN MHWVKQTPGRGLEWIGAIYPGNGDTSYNQKFKGKATLTADK SSSTAYMQLSSLTSEDSAVYYCARSTYYGGDWYFNVWGAGT TVTVSAGSTSGSGKPGSGEGSTKGQIVLSQSPAILSASPGEKVT MTCRASSSVSYIHWFQQKPGSSPKPWIYATSNLASGVPVRFSG SGSGTSYSLTISRVEAEDAATYYCQQWTSNPPTFGGGTKLEIK NLVPMVATV |
| SEQ ID NO: 309 | exemplary cell-targeting molecule 22 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPEVQLVESGGGLVQAGGSTRLSCAASGITFSINTM GWYRQAPGKQRELVALISSIGDTYYADSVKGRFTISRDNAKN TVYLQMNSLKPEDTAVYYCKRFRTAAQGTDYWGQGTQVTV SSAHHSEDNLVPMVATV |

-continued

| | | Sequence Listing |
|---|---|---|
| ID Number | Text Description | Biological Sequence |
| SEQ ID NO: 310 | exemplary cell-targeting molecule 23 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVFVTAEALRFR QIQRGFRTTLDDLSGRSYVMTAEDVDLTLNWGRLSSVLPDYH GQDSVRVGRISFGSINAILGSVALILNSHHHASAVAAEFPKPST PPGSSGGAPDIELTQSPSSFSVSLGDRVTITCKASEDIYNRLAW YQQKPGNAPRLLISGATSLETGVPSRFSGSGSGKDYTLSITSLQ TEDVATYYCQQYWSTPTFGGGTKLEIKGSTSGSGKPGSGEGS KVQLQESGPSLVQPSQRLSITCTVSGFSLISYGVHWVRQSPGK GLEWLGVIWRGGSTDYNAAFMSRLSITKDNSKSQVFFKMNSL QADDTAIYFCAKTLITTGYAMDYWGQGTTVTVSSNLVPMVA TV |
| SEQ ID NO: 311 | exemplary cell-targeting molecule 24 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHHASAVAAAHHSED PSSKAPKAPEVQLVESGGGLVQAGGSLRLSCAASGITFSINTM GWYRQAPGKQRELVALISSIGDTYYADSVKGRFTISRDNAKN TVYLQMNSLKPEDTAVYYCKRFRTAAQGTDYWGQGTQVTV SSNLVPMVATV |
| SEQ ID NO: 312 | exemplary cell-targeting molecule 25 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHHASAVAAEFTKPST PPGSSGGAPASVSDVPRDLEVVAATPTSLLISWCRQRCADSYR ITYGETGGNSPVQEFTVPGSWKTATISGLKPGVDYTITVYVVT HYYGWDRYSHPISINYRTGSNLVPMVATV |
| SEQ ID NO: 313 | exemplary cell-targeting molecule 26 | ASVSDVPRDLEVVAATPTSLLISWCRQRCADSYRITYGETGGN SPVQEFTVPGSWKTATISGLKPGVDYTITVYVVTHYYGWDRY SHPISINYRTGSEFPKPSTPPGSSGGAPAEFTLDFSTAKTYVDSL NVIRSAIGTPLQTISSGGTSLLMIDSGIGDNLFAVDILGFDFTLG RFNNLRLIVERNNLYVTGFVNRTNNVFYRFADFSHVTFPGTT AVTLSADSSYTTLQRVAGISRTGMQINRHSLTTSYLDLMSHSA TSLTQSVARAMLREVTVTAEALRFRQIQRGFRTTLDDLSGRSY VMTAEDVDLTLNWGRLSSVLPDYHGQDSVRVGRISFGSINAI LGSVALILNSHHHASAVAAANLVPMVATV |
| SEQ ID NO: 314 | exemplary cell-targeting molecule 27 | AEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHHASAVAAEFPKPST PPGSSGGAPAPTSSSTKKTQLQLEHLLLDLQMILNGINNYKNP KLTRMLTFKFYMPKKATELKHLQCLEEELKPLEEVLNLAQSK NFHLRPRDLISNINVIVLELKGSETTFMCEYADETATIVEFLNR WITFCQSIISTLTNLVPMVATV |
| SEQ ID NO: 315 | exemplary cell-targeting molecule 28 | NLVPMVATVAEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSATSLTQSVARAMLRFVTV TAEALRFRQIQRGFRTTLDDLSGRSYVMTAEDVDLTLNWGRL SSVLPDYHGQDSVRVGRISFGSINAILGSVALILNSHHHASAVA AGGGGSGGDIQMTQSPSSLSASVGDRVTITCKASEDIYNRLTW YQQKPGKAPKLLISGATSLETGVPSRFSGSGSGTDFTFTISSLQ PEDIATYYCQQWSNPYTFGQGTKVEIKGGGGSQVQLQESGP GLVRPSQTLSLTCTVSGFSLTSYGVHWVRQPPGRGLEWIGVM WRGGSTDYNAAFMSRLNITKDNSKNQVSLRLSSVTAADTAV YYCAKSMITTGFVMDSWGQGSLVTVSS |
| SEQ ID NO: 316 | exemplary cell-targeting molecule 29 | NLVPMVATVAEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSATSLTQSVARAMLRFVTV TAEALRFRQIQRGFRTTLDDLSGRSYVMTAEDVDLTLNWGRL |

Sequence Listing

| ID Number | Text Description | Biological Sequence |
|---|---|---|
| | | SSVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGSTSGSG KPGSGEGSTKGVQLQESGPGLVRPSQTLSLTCTVSGFSLTSY GVHWVRQPPGRGLEWIGVMWRGGSTDYNAAFMSRLNITKD NSKNQVSLRLSSVTAADTAVYYCAKSMITTGFVMDSWGQGS LVTVSS |
| SEQ ID NO: 317 | exemplary cell-targeting molecule 30 | NLVPMVATVAEFTLDESTAKTYVDSLNVIRSAIGIPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSATSLTQSVARAMLRFVTV TAEALRFRQIQRGFRTTLDDLSGRSYVMTAEDVDLTLNWGRL SSVLPDYHGQDSVRVGRISFGSINAILGSVALILNSHHHASAVA AEFPKPSTPPGSSGGAPDIQMTQSPSSLSASVGDRVTITCRASQ DVNTAVAWYQQKPGKAPKLLIYSASFLYSGVPSRFSGSRSGT DFTLTISSLQPEDFATYYCQQHYTTPPTFGQGTKVEIKGGGGS EVQLVESGGGLVQPGGSLRLSCAASGFNIKDTYIHWVRQAPG KGLEWVARIYPTNGYTRYADSVKGRFTISADTSKNTAYLQM NSLRAEDTAVYYCSRWGGDGFYAMDYWGQGTLVTVSS |
| SEQ ID NO: 318 | exemplary cell-targeting molecule 31 | GILGFVFTLAEFTLDFSTAKTYVDSLNVIRSAIGTPLQTISSGGT SLLMIDSGIGDNLFAVDILGFDFTLGRFNNLRLIVERNNLYVTG FVNRTNNVFYRFADFSHVTFPGTTAVTLSADSSYTTLQRVAGI SRTGMQINRHSLTTSYLDLMSHSATSLTQSVARAMLRFVTVT AEALRFRQIQRGFRTTLDDLSGRSYVMTAEDVDLTLNWGRLS SVLPDYHGQDSVRVGRISFGSINAILGSVALILNSHHHASAVA AEFPKPSTPPGSSGGAPEVQLVESGGGLVQPGGSLRLSCAASG FTFSDSWIHWVRQAPGKGLEWVAWISPYGGSTYYADSVKGR FTISADTSKNTAYLQMNSLRAEDTAVYYCARRHWPGGFDYW GQGTLVTVSSGGGGSGGGGSGGGGSGGGGSGGGGSDIQMTQ SPSSLSASVGDRVTITCRASQDVSTAVAWYQQKPGKAPKLLIY SASFLYSGVPSRFSGSGSGTDFILTISSLQPEDFATYYCQQYLY HPATFGQGTKVEIK |
| SEQ ID NO: 319 | exemplary cell-targeting molecule 32 | NLVPMVATVAEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSATSLTQSVARAMLRFVTV TAEALRFRQIQRGFRTTLDDLSGRSYVMTAEDVDLTLNWGRL SSVLPDYHGQDSVRVGRISFGSINAILGSVALILNSHHHASAVA AGGGGSGGDIQMTQSPSSLSASVGDRVTITCRASQGISSWLA WYQQKPEKAPKSLIYAASSLQSGVPSRFSGSGSGTDFTLTISSL QPEDFATYYCQQYNSYPYTFGQGTKLEIKGGGGSQVQLVQSG AEVKKPGASVKVSCKASGYTFTSYDVHWVRQAPGQRLEWM GWLHADTGITKFSQKFQGRVTITRDTSASTAYMELSSLRSEDT AVYYCARERIQLWFDYWGQGTLVTVSS |
| SEQ ID NO: 320 | exemplary cell-targeting molecule 33 | NLVPMVATVAEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSATSLTQSVARAMLRFVTV TAEALRFRQIQRGFRTTLDDLSGRSYVMTAEDVDLTLNWGRL SSVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 321 | exemplary cell-targeting molecule 34 | NLVPMVATVAEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSATSLTQSVARAMLRFVTV TAEALRFRQIQRGFRTTLDDLSGRSYVMTAEDVDLTLNWGRL SSVLPDYHGQDSVRVGRISFGSINAILGSVALILNSHHHASAVA AEFPKPSTPPGSSGGAPQVQLQQPGAELVKPGASVKMSCKTS GYTFTSYNVHWVKQTPGQGLEWIGAIYPGNGDTSFNQKFKG KATLTADKSSSTVYMQLSSLTSEDSAVYYCARSNYYGSSYV WFFDVWGAGTTVTVSSGSTSGSGKPGSGEGSQIVLSQSPTILS |

| | | |
|---|---|---|
| ID Number | Text Description | Biological Sequence |
| | | ASPGEKVTMTCRASSSVSYMDWYQQKPGSSPKPWIYATSNL ASGVPARFSGSGSGTSYSLTISRVEAEDAATYYCQQWISNPPT FGAGTKLELK |
| SEQ ID NO: 322 | exemplary cell-targeting molecule 35 | NLVPMVATVAEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSATSLTQSVARAMLRFVTV TAEALRFRQIQRGFRTTLDDLSGRSYVMTAEDVDLTLNWGRL SSVLPDYHGQDSVRVGRISFGSINAILGSVALILNSHHHASAVA AGGGGSGGQVQLVQSGAELVKPGASVKMSCKASGYTFTSYN MHWVKQTPGQGLEWIGAIYPGNGDTSYNQKFKGKATLTADK SSSTAYMQLSSLTSEDSAVYYCARAQLRPNYWYFDVWGAGT TVTVSSGGGGSGGGGSGGGGSGGGGSGGGGSDIVLSQSPAILS ASPGEKVTMTCRASSSVSYMHWYQQKPGSSPKPWIYATSNL ASGVPARFSGSGSGTSYSLTISRVEAEDAATYYCQQWISNPPT FGAGTKLELK |
| SEQ ID NO: 323 | exemplary cell-targeting molecule 36 | APTSSSTKKTQLQLEHLLLDLQMILNGINNYKNPKLTRMLTFK FYMPKKATELKHLQCLEEELKPLEEVLNLAQSKNEHLRPRDLI SNINVIVLELKGSETTFMCEYADETATIVEFLNRWITFCQSIIST LTEFPKPSTPPGSSGGAPNLVPMVATVAEFTLDFSTAKTYVDS LNVIRSAIGTPLQTISSGGTSLLMIDSGIGDNLFAVDILGFDFTL GRFNNLRLIVERNNLYVTGFVNRTNNVFYRFADFSHVTFPGT TAVTLSADSSYTTLQRVAGISRTGMQINRHSLTTSYLDLMSHS ATSLTQSVARAMLRFVTVTAEALRFRQIQRGFRTTLDDLSGRS YVMTAEDVDLTLNWGRLSSVLPDYHGQDSVRVGRISFGSINA ILGSVALILNSHHHASAVAA |
| SEQ ID NO: 324 | exemplary cell-targeting molecule 37 | GILGFVFTLAEFTLDFSTAKTYVDSLNVIRSAIGTPLQTISSGGT SLLMIDSGIGDNLFAVDILGFDFTLGRFNNLRLIVERNNLYVTG FVNRTNNVFYRFADFSHVTFPGTTAVTLSADSSYTTLQRVAGI SRTGMQINRHSLTTSYLDLMSHSATSLTQSVARAMLRFVTVT AEALRFRQIQRGFRTTLDDLSGRSYVMTAEDVDLTLNWGRLS SVLPLYYHGQDSVRVGRISFGSINAILGSVALILNSHHHASAVA AEFPKPSTPPGSSGGAPAPTSSSTKKTQLQLEHLLLDLQMILNG INNYKNPKLTRMLTFKFYMPKKATELKHLQCLEEELKPLEEV LNLAQSKNFHLRPRDLISNINVIVLELKGSETTFMCEYADETA TIVEFLNRWITFCQSIISTLT |
| SEQ ID NO: 325 | exemplary cell-targeting molecule 38 | MNLVPMVATVAEFTLDFSTAKTYVDSLNVIRSAIGTPLQTISS GGTSLLMIDSGIGDNLFAVDILGFDFTLGRFNNLRLIVERNNLY VTGFVNRTNNVFYRFADFSHVTFPGTTAVTLSADSSYTTLQR VAGISRTGMQINRHSLTTSYLDLMSHSATSLTQSVARAMLRF VTVTAEALRFRQIQRGFRTTLDDLSGRSYVMTAEDVDLTLNW GRLSSVLPDYHGQDSVRVGRISFGSINAILGSVALILNSHHHAS AVAAEFPKPSTPPGSSGGAPDIQMTQSPSSLSASVGDRVTITCK ASEDIYNRLTWYQQKPGKAPKLLISGATSLETGVPSRFSGSGS GTDFTFTISSLQPEDIATYYCQQYWSNPYTFGQGTKVEIKGSTS GSGKPGSGEGSTKGQVQLQESGPGLVRPSQTLSLTCTVSGFSL TSYGVHWVRQPPGRGLEWIGVMWRGGSTDYNAAFMSRLNIT KDNSKNQVSLRLSSVTAADTAVYYCAKSMITTGFVMDSWGQ GSLVTVSS |
| SEQ ID NO: 326 | exemplary cell-targeting molecule 39 | MNLVPMVATVAEFTLDFSTAKTYVDSLNVIRSAIGTPLQTISS GGTSLLMIDSGIGDNLFAVDILGFDFTLGRFNNLRLIVERNNLY VTGFVNRTNNVFYRFADFSHVTFPGTTAVTLSADSSYTTLQR VAGISRTGMQINRHSLTTSYLDLMSHSATSLTQSVARAMLRF VTVTAEALRFRQIQRGFRTTLDDLSGRSYVMTAEDVDLTLNW GRLSSVLPDYHGQDSVRVGRISFGSINAILGSVALILNSHHHAS AVAAEFPKPSTPPGSSGGAPDIQMTQSPSSLSASVGDRVTITCK ASEDIYNRLTWYQQKPGKAPKLLISGATSLETGVPSRFSGSGS GTDFTFTISSLQPEDIATYYCQQYWSNPYTFGQGTKVEIKGSTS GSGKPGSGEGSTKGQVQLQESGPGLVRPSQTLSLTCTVSGFSL TSYGVHWVRQPPGRGLEWIGVMWRGGSTDYNAAFMSRLNIT KDNSKNQVSLRLSSVTAADTAVYYCAKSMITTGFVMDSWGQ GSLVTVSS |
| SEQ ID NO: 327 | exemplary cell-targeting molecule 40 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTILDDLSGRSYVMTAEDVDLTLNWGRLSSVLPDYH GQDSVRVGRISFGSINAILGSVALILNSHHHASAVAAEFPKPST |

| ID Number | Text Description | Biological Sequence |
|---|---|---|
| | | PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGSTSGSGKPGSGE GSTKGQVQLQESGPGLVRPSQTLSLTCTVSGFSLTSYGVHWV RQPPGRGLEWIGVMWRGGSTDYNAAFMSRLNITKDNSKNQV SLRLSSVTAADTAVYYCAKSMITTGFVMDSWGQGSLVTVSSN LVPMVATV |
| SEQ ID NO: 328 | exemplary cell-targeting molecule 41 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGSTSGSGKPGSGE GSTKGQVQLQESGPGLVRPSQTLSLTCTVSGFSLTSYGVHWV RQPPGRGLEWIGVMWRGGSTDYNAAFMSRLNITKDNSKNQV SLRLSSVTAADTAVYYCAKSMITTGFVMDSWGQGSLVTVSSN LVPMVATV |
| SEQ ID NO: 329 | exemplary cell-targeting molecule 42 | MGILGFVFTLAEFTLDFSTAKTYVDSLNVIRSAIGTPLQTISSG GTSLLMIDSGIGDNLFAVDILGFDFTLGRFNNLRLIVERNNLYV TGFVNRTNNVFYRFADFSHVTFPGTTAVTLSADSSYTTLQRV AGISRTGMQINRHSLTTSYLDLMSHSATSLTQSVARAMLRFVT VTAEALRFRQIQRGFRTTLDDLSGRSYVMTAEDVDLTLNWGR LSSVLPDYHGQDSVRVGRISFGSINAILGSVALILNSHHASAV AAEFPKPSTPPGSSGGAPDIQMTQSPSSLSASVGDRVTITCKAS EDIYNRLTWYQQKPGKAPKLLISGATSLETGVPSRFSGSGSGT DFTFTISSLQPEDIATYYCQQYWSNPYTFGQGTKVEIKGSTSGS GKPGSGEGSTKGQVQLQESGPGLVRPSQTLSLTCTVSGFSLTS YGVHWVRQPPGRGLEWIGVMWRGGSTDYNAAFMSRLNITK DNSKNQVSLRLSSVTAADTAVYYCAKSMITTGFVMDSWGQG SLVTVSS |
| SEQ ID NO: 330 | exemplary cell-targeting molecule 43 | MDIQMTQSPSSLSASVGDRVTITCRASQDVNTAVAWYQQKP GKAPKLLIYSASFLYSGVPSRFSGSRSGTDFTLTISSLQPEDFAT YYCQQHYTTPPTFGQGTKVEIKRTGSTSGSGKPGSGEGSEVQL VESGGGLVQPGGSLRLSCAASGFNIKDTYIHWVRQAPGKGLE WVARIYPTNGYTRYADSVKGRFTISADTSKNTAYLQMNSLRA EDTAVYYCSRWGGDGFYAMDVWGQGTLVTVSSEFPKPSTPP GSSGGAPGILGFVFTLAEFTLDFSTAKTYVDSLNVIRSAIGTPL QTISSGGTSLLMIDSGIGDNLFAVDILGFDFTLGRFNNLRLIVER NNLYVTGFVNRTNNVFYRFADFSHVTFPGTTAVTLSADSSYT TLQRVAGISRTGMQINRHSLTTSYLDLMSHSATSLTQSVARA MLRFVTVTAEALRRQIQRGFRTTLDDLSGRSYVMTAEDVDL TLNWGRLSSVLPDYHGQDSVRVGRISFGSINAILGSVALILNSH HHASAVAA |
| SEQ ID NO: 331 | exemplary cell-targeting molecule 44 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLAEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLDLMSHSATSLTQSVARA MLRFVTVTAEALRFRQIQRGFRTTLDDLSGRSYVMTAEDVDL TLNWGRLSSVLPDYHGQDSVRVGRISFGSINAILGSVALILNSH HHASAVAA |
| SEQ ID NO: 332 | exemplary cell-targeting molecule 45 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCRASQPVNTAVA WYQQKPGKAPKLLIYSASFLYSGVPSRFSGSRSGTDFTLTISSL QPEDFATYYCQQHYTTPPTFGQGTKVEIKGGGSEVQLVESG GGLVQPGGSLRLSCAASGFNIKDTYIHWVRQAPGKGLEWVA |

| | | |
|---|---|---|
| ID Number | Text Description | Biological Sequence |
| | | RIYPTNGYTRYADSVKGRFTISADTSKNTAYLQMNSLRAEDT<br>AVYYCSRWGGDGFYAMDYWGQGTLVTVSSNLVPMVATV |
| SEQ ID<br>NO: 333 | exemplary<br>cell-targeting<br>molecule 46 | MAEFTLDFSTAKTYVDSLNVIRSAIGTPLQTISSGGTSLLMIDS<br>GIGDNLFAVDILGFDFTLGRFNNLRLIVERNNLYVTGFVNRTN<br>NVFYRFADFSHVTFPGTTAVTLSADSSYTTLQRVAGISRTGMQ<br>INRHSLTTSYLDLMSHSATSLTQSVARAMLRFVTVTAEALRFR<br>QIQRGFRTTLDDLSGRSYVMTAEDVDLTLNWGRTSSVLPDYH<br>GQDSVRVGRISFGSINAILGSVALILNSHHASAVAAEFPKPST<br>PPGSSGGAPEVQLVESGGGLVQPGGSLRLSCAASGFTFSDSWI<br>HWVRQAPGKGLEWVAWISPYGGSTYYADSVKGRFTISADTS<br>KNTAYLQMNSLRAEDTAVYYCARRHWPGGFDYWGQGTLVT<br>VSSGGGGSGGGGSGGGGSGGGGSGGGGSDIQMTQSPSSLSAS<br>VGDRVTITLCRASQDVSTAVAWYQQKPGKAPKLLIYSASFLYS<br>GVPSRFSGSGSGTDFTLTISSLQPEDFATYYCQQYLYHPATFG<br>QGTKVEIKGILGFVFTL |
| SEQ ID<br>NO: 334 | exemplary<br>cell-targeting<br>molecule 47 | MAEFTLDFSTAKTYVDSLNVIRSAIGTPLQTISSGGTSLLMIDS<br>GIGDNLFAVDILGFDFTLGRFNNLRLIVERNNLYVTGFVNRTN<br>NVFYRFADFSHVTFPGTTAVTLSADSSYTTLQRVAGISRTGMQ<br>INRHSLTTSYLDLMSHSATSLTQSVARAMLRFVTVTAEALRFR<br>QIQRGFRTTLDDLSGRSYVMTAEDVDLTLNWGRLSSVLPDYH<br>GQDSVRVGRISFGSINAILGSVALILNSHHASAVAAEFPKPST<br>PPGSSGGAPEVQLVESGGGLVQPGGSLRLSCAASGFTFSDSWI<br>HWVRQAPGKGLEWVAWISPYGGSTYYADSVKGRFTISADTS<br>KNTAYLQMNSLRAEDTAVYYCARRHWPGGFDYWGQGTLVT<br>VSSGGGGSGGGGSGGGGSGGGGSGGGGSDIQMTQSPSSLSAS<br>VGDRVTITCRASQDVSTAVAWYQQKPGKAPKLLIYSASFLYS<br>GVPSRFSGSGSGTDFTLTISSLQPEDFATYYCQQYLYHPATFG<br>QGTKVEIKGILGFVFTL |
| SEQ ID<br>NO: 335 | exemplary<br>cell-targeting<br>molecule 48 | MAEFTLDFSTAKTYVDSLNVIRSAIGTPLQTISSGGTSLLMIDS<br>GIGDNLFAVDILGFDFTLGRFNNLRLIVERNNLYVTGFVNRTN<br>NVFYRFADFSHVTFPGTTAVTLSADSSYTTLQRVAGISRTGMQ<br>INRHSLTTSYLDLMSHSATSLTQSVARAMLRFVTVTAEALRFR<br>QIQRGFRTTLDDLSGRSYVMTAEDVDLTLNWGRLSSVLPDYH<br>GQDSVRVGRISFGSINAILGSVALILNSHHASAVAAEFPKPST<br>PPGSSGGAPDIQMTQSPSSLSASVGDRVTITCRASQGISSWLA<br>WYQQKPEKAPKSLIYAASSLQSGVPSRFSGSGSGTDFTLTISSL<br>QPEDFATYYCQQYNSYPYTFGQGTKLEIKGGGGSQVQLVQSG<br>AEVKKPGASVKVSCKASGYTFTSYDVHWVRQAPGQRLEWM<br>GWLHADTGITKFSQKFQGRVTITRDTSASTAYMELSSLRSEDT<br>AVYYCARERIQLWFDYWGQGTLVTVSSNLVPMVATV |
| SEQ ID<br>NO: 336 | exemplary<br>cell-targeting<br>molecule 49 | MAEFTLDFSTAKTYVDSLNVIRSAIGTPLQTISSGGTSLLMIDS<br>GIGDNLFAVDILGFDFTLGRFNNLRLIVERNNLYVTGFVNRTN<br>NYFYRFADFSHVTFPGTTAVTLSADSSYTTLQRVAGISRTGMQ<br>INRHSLTTSYLDLMSHSATSLTQSVARAMLRFVTVTAEALRFR<br>QIQRGFRTTLDDLSGRSYVMTAEDVDLTLNWGRLSSVLPDYH<br>GQDSVRVGRISFGSINAILGSVALILNSHHASAVAAEFPKPST<br>PPGSSGGAPDIQMTQSPSSLSASVGDRVTITCKASEDIYNRLT<br>WYQQKPGKAPKLLISGATSLETGVPSRFSGSGSGTDFTFTISSL<br>QPEDIATYYCQQYWSNPYTFGQGTKVEIKGGGGSQVQLQESG<br>PGLVRPSQTLSLTCTVSGFSLTSYGVHWVRQPPGRGLEWIGV<br>MWRGGSTDYNAAFMSRLNITKDNSKNQVSLRLSSVTAADTA<br>VYYCAKSMITTGFVMDSWGQGSLVTVSSNLVPMVATV |
| SEQ ID<br>NO: 337 | exemplary<br>cell-targeting<br>molecule 50 | QVQLQQPGAELVKPGASVKMSCKTSGYTFTSYNVHWVKQTP<br>GQGLEWIGAIYPGNGDTSFNQKFKGKATLTADKSSSTVYMQL<br>SSLTSEDSAVYYCARSNYYGSSYVWFFDVWGAGTTVTVSSGS<br>TSGSGKPGSGEGSQIVLSQSPTILSASPGEKVTMTCRASSSVSY<br>MDWYQQKPGSSPKPWIYATSNLASGVPARFSGSGSGISYSLTI<br>SRVEAEDAATYYCQQWISNPPTFGAGTKLELKEFPKPSTPPGS<br>SGGAPGILGFVFTLAEFTLDFSTAKTYVDSLNVIRSAIGTPLQTI<br>SSGGTSLLMIDSGIGDNLFAVDILGFDFTLGRFNNLRLIVERNN<br>LYVTGFVNRTNNVFYRFADFSHVTFPGTTAVTLSADSSYTTL<br>QRVAGISRTGMQINRHSLTTSYLDLMSHSATSLTQSVARAML<br>RFVTVTAEALRERQIQRGFRTTLDDLSGRSYVMTAEDVDLTL<br>NWGRLSSVLPDYHGQDSVRVGRISFGSINAILGSVALILNSHH<br>HASAVAA |
| SEQ ID<br>NO: 338 | exemplary<br>cell-targeting<br>molecule 51 | MQVQLQQPGAELVKPGASVKMSCKTSGYTFTSYNVHWVKQ<br>TPGQGLEWIGALYPGNGDTSFNQKFKGKATLTADKSSSTVYM<br>QLSSLTSEDSAVYYCARSNYYGSSYVWFFDVWGAGTTVTVS |

| | | |
|---|---|---|
| | | Sequence Listing |
| ID Number | Text Description | Biological Sequence |
| | | SGSTSGSGKPGSGEGSQIVLSQSPTILSASPGEKVTMTCRASSS<br>VSYMDWYQQKPGSSPKPWIYATSNLASGVPARFSGSGSGTSY<br>SLTISRVEAEDAATYYCQQWISNPPTFGAGTKLELKEFPKPSTP<br>PGSSGGAPGILGFVFTLAEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNVFYRFADFSHVTFPGTTAVTLSADSSY<br>TTLQRVAGISRTGMQINRHSLTTSYLDLMSHSATSLTQSVARA<br>MLRFVTVTAEALRFRQIQRGFRTTLDDLSGRSYVMTAEDVDL<br>TLNWGRLSSVLPDYHGQDSVRVGRISFGSINAILGSVALILNSH<br>HHASAVAA |
| SEQ ID NO: 339 | exemplary cell-targeting molecule 52 | MDIQMTQSPSSLSASVGDRVTITCRASQDVNTAVAWYQQKP<br>GKAPKLLIYSASFLYSGVPSRFSGSRSGTDFTLTISSLQPEDFAT<br>YYCQQHYTTPPTFGQGTKVEIKRTGSTSGSGKPGSGEGSEVQL<br>VESGGGLVQPGGSLRLSCAASGFNIKDTYIHWVRQAPGKGLE<br>WVARIYPTNGYTRYADSVKGRFTISADTSKNTAYLQMNSLRA<br>EDTAVYYCSRWGGDGFYAMDVWGQGTLVTVSSEFPKPSTPP<br>GSSGGAPGILGFVFTLAEFTLDFSTAKTYVDSLNVIRSAIGTPL<br>QTISSGGTSLLMIDSGIGDNLFAVDILGFDFTLGRFNNLRLIVER<br>NNLYVTGFVNRTNNVFYRFADFSHVTFPGTTAVTLSADSSYT<br>TLQRVAGISRTGMQINRHSLTTSYLDLMSHSATSLTQSVARA<br>MLRFVTVTAEALRFRQIQRGFRTTLDDLSGRSYVMTAEDVDL<br>TLNWGRLSSVLPDYHGQDSVRVGRISFGSINAILGSVALILNSH<br>HHASAVAAKDEL |
| SEQ ID NO: 340 | exemplary cell-targeting molecule 53 | MDIQMTQSPSSLSASVGDRVTITCRASQDVNTAVAWYQQKP<br>GKAPKLLIYSASFLYSGVPSRFSGSRSGTDFTLTISSLQPEDFAT<br>YYCQQHYTTPPTFGQGTKVEIKRTGSTSGSGKPGSGEGSEVQL<br>VESGGGLVQPGGSLRLSCAASGFNIKDTYIHWVRQAPGKGLE<br>WVARIYPTNGYTRYADSVKGRFTISADTSKNTAYLQMNSLRA<br>EDTAVYYCSRWGGDGFYAMDVWGQGTLVTVSSEFPKPSTPP<br>GSSGGAPGILGFVFTLAEFTLDFSTAKTYVDSLNVIRSAIGTPL<br>QTISSGGTSLLMIDSGIGDNLFAVDILGFDFTLGRFNNLRLIVER<br>NNLYVTGFVNRTNNVFYRFADFSHVTFPGTTAVTLSADSSYT<br>TLQRVAGISRTGMQINRHSLTTSYLDLMSHSATSLTQSVARA<br>MLRFVTVTAEALRFRQIQRGFRTTLDDLSGRSYVMTAEDVDL<br>TLNWGRLSSVLPDYHGQDSVRVGRISFGSINAILGSVALILNSH<br>HHASAVAAKDEL |
| SEQ ID NO: 341 | exemplary cell-targeting molecule 54 | MDIELTQSPSSFSVSLGDRVTITCKASEDIYNRLAWYQQKPGN<br>APRLLISGATSLETGVPSRFSGSGSGKDYTLSITSLQTEDVATY<br>YCQQYWSTPTFGGGTKLEIKGSTSGSGKPGSGEGSKVQLQES<br>GPSLVQPSQRLSITCTVSGFSLISYGVHWVRQSPGKGLEWLGV<br>IWRGGSTDYNAAFMSRLSITKDNSKSQVFFKMNSLQADDTAI<br>YFCAKTLITTGYAMDYWGQGTTVTVSSEFPKPSTPPGSSGGAP<br>GILGFVFTLAEFTLDFSTAKTYVDSLNVIRSAIGTPLQTISSGGT<br>SLLMIDSGIGDNLFAVDILGFDFTLGRFNNLRLIVERNNLYVTG<br>FVNRTNNVFYRFADFSHVTFPGTTAVTLSADSSYTTLQRVAGI<br>SRTGMQINRHSLTTSYLDLMSHSATSLTQSVARAMLRFVTVT<br>AEALRFRQIQRGFRTTLDDLSGRSYVMTAEDVDLTLNWGRLS<br>SVLPDYHGQDSVRVGRISFGSINAILGSVALILNSHHHASAVA<br>AKDEL |
| SEQ ID NO: 342 | exemplary cell-targeting molecule 55 | MDIELTQSPSSFSVSLGDRVTITCKASEDIYNRLAWYQQKPGN<br>APRLLISGATSLETGVPSRFSGSGSGKDYTLSITSLQTEDVATY<br>YCQQYWSTPTFGGGTKLEIKGSTSGSGKPGSGEGSKVQLQES<br>GPSLVQPSQRLSITCTVSGFSLISYGVHWVRQSPGKGLEWLGV<br>IWRGGSTDYNAAFMSRLSITKDNSKSQVFFKMNSLQADDTAI<br>YFCAKTLITTGYAMDYWGQGTTVTVSSEFPKPSTPPGSSGGAP<br>GILGFVFTLAEFTLDFSTAKTYVDSLNVIRSAIGTPLQTISSGGT<br>SLLMIDSGIGDNLFAVDILGFDFTLGRFNNLRLIVERNNLYVTG<br>FVNRTNNVFYRFADFSHVTFPGTTAVTLSADSSYTTLQRVAGI<br>SRTGMQINRHSLTTSYLDLMSHSATSLTQSVARAMLRFVTVT<br>AEALRFRQIQRGFRTTLDDLSGRSYVMTAEDVDLTLNWGRLS<br>SVLPDYHGQDSVRVGRISFGSINAILGSVALIENSHHHASAVA<br>AKDEL |
| SEQ ID NO: 343 | exemplary cell-targeting molecule 56 | MDIVMTQAAPSIPVITGESVSISCRSSKSELNSNGNTYLYWFL<br>QRPGQSPQLLIYRMSNLASGVPDRFSGSGSGTAFTLRISRVEAE<br>DVGVYYCMQHLEYPFTFGAGTKLELKGSTSGSGKPGSGEGSE<br>VQLQQSGPELIKPGASVKMSCKASGYTFTSYVMHWVKQKPG<br>QGLEWIGYINPYNDGTKYNEKFKGKATLTSDKSSSTAYMELS<br>SLTSEDSAVYYCARGTYYYGSRVFDYWGQGTTLTVSSAEFPK<br>PSTPPGSSGGAPGILGFVFTLAEFTLDFSTAKTYVDSLNVIRSAI |

Sequence Listing

| ID Number | Text Description | Biological Sequence |
|---|---|---|
| | | GTPLQTISSGGTSLLMIDSGIGDNLFAVDILGFDFTLGRFNNLR<br>LIVERNNLYVTGFVNRTNNVFYRFADFSHVTFPGTTAVTLSA<br>DSSYTTLQRVAGISRTGMQINRHSLTTSYLDLMSHSATSLTQS<br>VARAMLRFVTVTAEALRFRQIQRGFRTTLDDLSGRSYVMTAE<br>DVDLTLNWGRLSSVLPDYHGQDSVRVGRISFGSINAILGSVAL<br>ILNSHHHASAVAAKDEL |
| SEQ ID NO: 344 | exemplary cell-targeting molecule 57 | MDIVMTQAAPSIPVTPGESVSISCRSSKSLLNSNGNTYLYWFL<br>QRPGQSPQLLIYRMSNLASGVPDRFSGSGSGTAFTLRISRVEAE<br>DVGVYYCMQHLEYPPTFGAGTKLELKGSTSGSGKPGSGEGSE<br>VQLQQSGPELIKPGASVKMSCKASGYTFTSYVMHWVKQKPG<br>QGLEWIGYINPYNDGTKYNEKFKGKATLTSDKSSSTAYMELS<br>SLTSEDSAVYYCARGTYYYGSRVFDYWGQGTTLTVSSAEFPK<br>PSTPPGSSGGAPGILGFVFTLAEFTLDESTAKTYVDSLNVIRSAI<br>GTPLQTISSGGTSLLMIDSGIGDNLFAVDILGFDFTLGRFNNLR<br>LIVERNNLYVTGFVNRTNNVFYRFADFSHVTFPGTTAVTLSA<br>DSSYTTLQRVAGISRTGMQINRHSLITSYLDLMSHSATSLTQS<br>VARAMLRFVTVTAEALRFRQIQRGFRTTLDDLSGRSYVMTAE<br>DVDLTLNWGRLSSVLPDYHGQDSVRVGRISFGSINAILGSVAL<br>ILNSHHHASAVAAKDEL |
| SEQ ID NO: 345 | exemplary cell-targeting molecule 58 | MDIQLTQSPLSLPVTLGQPASISCRSSQSLVHRNGNTYLHWFQ<br>QRPGQSPRLLIYTVSNRFSGVPDRFSGSGSGTDFTLKISRVEAE<br>DVGVYFCSQSSHVPPTFGAGTRLEIKGSTSGSGKPGSGEGSTK<br>GQVQLQQSGSELKKPGASVKVSCKASGYTFTNYGVNWIKQA<br>PGQGLQWMGWINPNTGEPTFDDDFKGRFAFSLDTSVSTAYLQ<br>ISSLKADDTAVYFCSRSRGKNEAWFAYWGQGTLVTVSSEFPK<br>PSTPPGSSGGAPGILGFVFTLAEFTLDFSTAKTYVDSLNVIRSAI<br>GTPLQTISSGGTSLLMIDSGIGDNLFAVDILGFDFTLGRFNNLR<br>LIVERNNLYVTGFVNRTNNVFYRFADFSHVTFPGTTAVTLSA<br>DSSYTTLQRVAGISRTGMQINRHSLTTSYLDLMSHSATSLTQS<br>VARAMLRFVTVTAEALRFRQIQRGFRTTLDDLSGRSYVMTAE<br>DVDLTLNWGRLSSVLPDYHGQDSVRVGRISFGSINAILGSVAL<br>ILNSHHHASAVAAKDEL |
| SEQ ID NO: 346 | exemplary cell-targeting molecule 59 | MDIQLTQSPLSLPVTLGQPASISCRSSQSLVHRNGNTYLHWFQ<br>QRPGQSPRLLIYTVSNRFSGVPDRFSGSGSGTDFTLKISRVEAE<br>DVGVYFCSQSSHVPPTFGAGTRLEIKGSTSGSGKPGSGEGSTK<br>GQVQLQQSGSELKKPGASVKVSCKASGYTFTNYGVNWIKQA<br>PGQGLQWMGWINPNTGEPTFDDDFKGRFAFSLDTSVSTAYLQ<br>ISSLKADDTAVYFCSRSRGKNEAWFAYWGQGTLVTVSSEFPK<br>PSTPPGSSGGAPGILGFVFTLAEFTLDFSTAKTYVDSLNVIRSAI<br>GTPLQTISSGGTSLLMIDSGIGDNLFAVDILGFDFTLGRFNNLR<br>LIVERNNLYVTGFVNRTNNVFYRFADFSHVTFPGTTAVTLSA<br>DSSYTTLQRVAGISRTGMQINRHSLTTSYLDLMSHSATSLTQS<br>VARAMLRFVTVTAEALRFRQIQRGFRTTLDDLSGRSYVMTAE<br>DVDLTLNWGRLSSVLPDYHGQDSVRVGRISFGSINAILGSVAL<br>ILNSHHHASAVAAKDEL |
| SEQ ID NO: 347 | exemplary cell-targeting molecule 60 | MEVQLVESGGGLVQAGGSLRLSCAASGITFSINTMGWYRQAP<br>GKQRELVALISSIGDTYYADSVKGRFTISRDNAKNTLQMN<br>SLKPEDTAVYYCKRFRTAAQGTDYWGQGTQVTVSSAHHSED<br>PSSKAPKAPGILGFVFTLAEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNVFYRFADFSHVTFPGTTAVTLSADSSY<br>TTLQRVAGISRTGMQINRHSLTTSYLDLMSHSATSLTQSVARA<br>MLRFVTVTAEALRFRQIQRGFRTTLDDLSGRSYVMTAEDVDL<br>TLNWGRLSSVLPDYHGQDSVRVGRISFGSINAILGSVALILNSH<br>HHASAVAAKDEL |
| SEQ ID NO: 348 | exemplary cell-targeting molecule 61 | MEVQLVESGGGLVQAGGSLRLSCAASGITFSINTMGWYRQAP<br>GKQRELVALISSIGDTYYADSVKGRITTISRDNAKNTVYLQMN<br>SLKPEDTAVYYCKRFRTAAQGTDYWGQGTQVTVSSEFPKPST<br>PPGSSGGAPGILGFVFTLAEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNVFYRFADFSHVTFPGTTAVTLSADSSY<br>TTLQRVAGISRTGMQINRHSLTTSYLDLMSHSATSLTQSVARA<br>MLRFVTVTAEALRFRQIQRGFRTTLDDLSGRSYVMTAEDVDL<br>TLNWGRLSSVLPDYHGQDSVRVGRISFGSINAILGSVALILNSH<br>HHASAVAAKDEL |
| SEQ ID NO: 349 | exemplary cell-targeting molecule 62 | MEVQLVESGGGLVQAGGSLRLSCAASGITFSINTMGWYRQAP<br>GKQRELVALISSIGDTYYADSVKGRITTISRDNAKNTVYLQMN<br>SLKPEDTAVYYCKRFRTAAQGTDYWGQGTQVTVSSAHHSED |

| ID Number | Text Description | Biological Sequence |
|---|---|---|
| | | PSSKAPKAPGILGFVFTLGILGFVFTLAEFTLDFSTAKTYVDSL NVIRSAIGTPLQTISSGGTSLLMIDSGIGDNLFAVDILGFDFTLG RFNNLRLIVERNNLYVTGFVNRTNNVFYRFADFSHVTFPGTT AVTLSADSSYTTLQRVAGISRTGMQINRHSLTTSYLDLMSHSA TSLTQSVARAMLRFVTVTAEALRFRQIQRGFRTTLDDLSGRSY VMTAEDVDLTLNWGRLSSVLPDYHGQDSVRVGRISFGSINAI LGSVALINSHHHASAVAAKDEL |
| SEQ ID NO: 350 | exemplary cell-targeting molecule 63 | MEVQLVESGGGLVQAGGSLRLSCAASGITFSINTMGWYRQAP GKQRELVALISSIGDTYYADSVKGRFTISRDNAKNTVYLQMN SLKPEDTAVYYCKRFRTAAQGTDYWGQGTQVTVSSEFPKPST PPGSSGGAPGILGFVFTLGILGFVFTLAEFTLDFSTAKTYVDSL NVIRSAIGTPLQTISSGGTSLLMIDSGIGDNLFAVDILGFDFTLG RFNNLRLIVERNNLYVTGFVNRTNNVFYRFADFSHVTFPGTT AVTLSADSSYTTLQRVAGISRTGMQINRHSLTTSYLDLMSHSA TSLTQSVARAMLRFVTVTAEALRFRQIQRGFRTTLDDLSGRSY VMTAEDVDLTLNWGRLSSVLPDYHGQDSVRVGRISFGSINAI LGSVALILNSHHHASAVAAKDEL |
| SEQ ID NO: 351 | exemplary cell-targeting molecule 64 | MAPTSSSTKKTQLQLEHLLLDLQMILNGINNYKNPKLTRMLT FKFYMPKKATELKHLQCLEEEELKPLEEVLNLAQSKNFHLRPR DLISNINVIVLELKGSETTFMCEYADETATIVEFLNRWITFCQSI ISTLTEFPKPSTPPGSSGGAPGILGFVFTLAEFTLDFSTAKTYVD SLNVIRSAIGTPLQTISSGGTSLLMIDSGIGDNLFAVDILGFDFT LGRFNNLRLIVERNNLYVTGFVNRTNNVFYRFADFSHVTFPG TTAVTLSADSSYTTLQRVAGISRTGMQINRHSLTTSYLDLMSH SATSLTQSVARAMLRFVTVTAEALRFRQIQRGFRTTLDDLSGR SYVMTAEDVDLTLNWGRLSSVLPDYHGQDSVRVGRISFGSIN AILGSVALILNSHHHASAVAAKDEL |
| SEQ ID NO: 352 | exemplary cell-targeting molecule 65 | MAPTSSSIRKTQLQLEHLLLDLQMILNGINNYKNPKLTRMLT FKFYMPKKATELKHLQCLEEEELKPLEEVLNLAQSKNFHLRPR DLISNINVIVLELKGSETTFMCEYADETATIVEFLNRWITFCQSI ISTLTEFPKPSTPPGSSGGAPGILGFVFTLAEFTLDFSTAKTYVD SLNVIRSAIGTPLQTISSGGTSLLMIDSGIGDNLFAVDILGFDFT LGRFNNLRLIVERNNLYVTGFVNRTNNVFYRFADFSHVTFPG TTAVTLSADSSYTTLQRVAGISRTGMQINRHSLTTSYLDLMSH SATSLTQSVARAMLRFVTVTAEALRFRQIQRGFRTTLDDLSGR SYVMTAEDVDLTLNWGRLSSVLPDYHGQDSVRVGRISFGSIN AILGSVALILNCHHHASAVAAKDEL |
| SEQ ID NO: 353 | exemplary cell-targeting molecule 66 | MQVQLVQSGAELVKPGASVKMSCKASGYTFTSYNMHWVKQ TPGQGLEWIGAIYPGNGDTSYNQKFKGKATLTADKSSSTAYM QLSSLTSEDSAVYYCARAQLRPNYWYFDVWGAGTTVTVSSG STSGSGKPGSGEGSDIVLSQSPAILSASPGEKVTMTCRASSSVS YMHWYQQKPGSSPKPWIYATSNLASGVPARFSGSGSGTSYSL TISRVEAEDAATYYCQQWISNPPTFGAGTKLELKEFPKPSTPP GSSGGAPGILGFVFTLAEFTLDFSTAKTYVDSLNVIRSAIGTPL QTISSGGTSLLMIDSGIGDNLFAVDILGFDFTLGRFNNLRLIVER NNLYVTGFVNRTNNVFYREADFSHVTFPGTTAVTLSADSSYT TLQRVAGISRTGMQINRHSLTTSYLDLMSHSATSLTQSVARA MLRFVTVTAEALRERQIQRGFRTTLDDLSGRSYVMTAEDVDL TLNWGRLSSVLPDYHGQDSVRVGRISFGSINAILGSVALILNSH HHASAVAA |
| SEQ ID NO: 354 | exemplary cell-targeting molecule 67 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLAEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLDLMSHSATSLTQSVARA MLRFVTVTAEALRFRQIQRGFRTTLDDLSGRSYVMTAEDVDL TLNWGRLSSVLPDYHGQDSVRVGRISFGSINAILGSVALILNSH HHASAVAA |
| SEQ ID NO: 355 | exemplary cell-targeting molecule 68 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY |

| ID Number | Text Description | Biological Sequence |
|---|---|---|
| | | SLTISRVEAEDAATYYCQQWISNPPTFGAGTKLELKEFPKPSTP PGSSGGAPGILGFVFTLAEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFTGTTAVTLSADSSY TTLQRVAGISRTGMQINRHSLTTSYLDLMSHSATSLTQSVARA MLRFVTVTAEALRFRQIQRGFRTTLDDLSGRSYVMTAEDVDL TLNWGRLSSVLPDYHGQDSVRVGRISFGSINAILGSVALILNSH HHASAVAA |
| SEQ ID NO: 356 | exemplary cell-targeting molecule 69 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLAEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLDLMSHSATSLTQSVARA MLRFVTVTAEALRFRQIQRGFRTTLDDLSGRSYVMTAEDVDL TLNWGRLSSVLPDYHGQDSVRVGRISFGSINAILGSVALILNSH HHASAVAA |
| SEQ ID NO: 357 | exemplary cell-targeting molecule 70 | MQVQLQQPGAELVKPGASVKMSCKASGYTFTSYNMHWVKQ TPGRGLEWIGAIYPGNGDTSYNQKFKGKATLTADKSSSTAYM QLSSLTSEDSAVYYCARSTYYGGDWYFNVWGAGTTVTVSAG STSGSGKPGSGEGSTKGQIVLSQSPAILSASPGEKVTMTCRASS SVSYIHWFQQKPGSSPKPWIYATSNLASGVPVRFSGSGSGTSY SLTISRVEAEDAATYYCQQWTSNPPTFGGGTKLEIKEFPKPSTP PGSSGGAPGILGFVFTLAEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLDLMSHSATSLTQSVARA MLRFVTVTAEALRFRQIQRGFRTTLDDLSGRSYVMTAEDVDL TLNWGRLSSVLPDYHGQDSVRVGRISFGSINAILGSVALILNSH HHASAVAA |
| SEQ ID NO: 358 | exemplary cell-targeting molecule 71 | MEVQLVESGGGLVQPGRSLRLSCAASGFTFNDYAMHWVRQA PGKGLEWVSTISWNSGSIGYADSVKGRFTISRDNAKKSLYLQ MNSLRAEDTALYYCAKDIQYGNYYYGMDVWGQGTTVTVSS GSTSGSGKPGSGEGSEIVLTQSPATLSLSPGERATLSCRASQSV SSYLAWYQQKPGQAPRLLIYDASNRATGIPARFSGSGSGTDFT LTISSLEPEDFAVYYCQQRSNWPITFGQGTRLEIKEFPKPSTPPG SSGGAPGILGFVFTLAEFTLDFSTAKTYVDSLNVIRSAIGTPLQ TISSGGTSLLMIDSGIGDNLFAVDILGFDFTLGRFNNLRLIVERN NLYVTGFVNRTNNVFYRFADFSHVTFPGTTAVTLSADSSYTT LQRVAGISRTGMQINRHSLTTSYLDLMSHSATSLTQSVARAM LRFVTVTAEALRFRQIQRGFRTTLDDLSGRSYVMTAEDVDLT LNWGRLSSVLPDYHGQDSVRVGRISFGSINAILGSVALILNSH HHASAVAA |
| SEQ ID NO: 359 | exemplary cell-targeting molecule 72 | MEIVLTQSPATLSLSPGERATLSCRASQSVSSYLAWYQQKPGQ APRLLIYDASNRATGIPARFSGSGSGTDFTLTISSLEPEDFAVY YCQQRSNWPITFGQGTRLEIKGGGGSGGGGSGGGGSGGGGSG GGGSEVQLVESGGGLVQPGRSLRLSCAASGFTFNDYAMHWV RQAPGKGLEWVSTISWNSGSIGYADSVKGRFTISRDNAKKSL YLQMNSLRAEDTALYYCAKDIQYGNYYYGMDVWGQGTTVT VSSEFPKPSTPPGSSGGAPGILGFVFTLAEFTLDFSTAKTYVDS LNVIRSAIGTPLQTISSGGTSLLMIDSGIGDNLFAVDILGFDFTL GRFNNLRLIVERNNLYVTGFVNRTNNVFYRFADFSHVTFPGT TAVTLSADSSYTTLQRVAGISRTGMQINRHSLTTSYLDLMSHS ATSLTQSVARAMLRFVTVTAEALRFRQIQRGFRTTLDDLSGRS YVMTAEDVDLTLNWGRLSSVLPDYHGQDSVRVGRISFGSINA ILGSVALILNSHHHASAVAA |
| SEQ ID NO: 360 | exemplary cell-targeting molecule 73 | MQIVLSQSPAILSASPGEKVTMTCRASSSVSYMHWYQQKPGS SPKPWIYAPSNLASGVPARFSGSGSGTSYSLTISRVEAEDAATY YCQQWSFNPPTFGAGTKLELKSGGGGSGGGGSGGGGSGGGG SGGGGSQAYLQQSGAELVRPGASVKMSCKASGYTFTSYNMH WVKQTPRQGLEWIGAIYPGNGDTSYNQKFKGKATLTVDKSSS TAYMQLSSLTSEDSAVYFCARVVYYSNSYWYFDVWGTGTTV TVSEFPKPSTPPGSSGGILGFVFTLGAPAEFTLDFSTAKTYVDS LNVIRSAIGTPLQTISSGGTSLLMIDSGIGDNLFAVDILGFDFTL GRFNNLRLIVERNNLYVTGFVNRTNNVFYRFADFSHVTFPGT |

Sequence Listing

| ID Number | Text Description | Biological Sequence |
|---|---|---|
| | | TAVTLSADSSYTTLQRVAGISRTGMQINRHSLTTSYLDLMSHS ATSLTQSVARAMLRFVTVTAEALRFRQIQRGFRTTLDDLSGRS YVMTAEDVDLTLNWGRLSSVLPDYHGQDSVRVGRISFGSINA ILGSVALILNSHHHASAVAA |
| SEQ ID NO: 361 | exemplary cell-targeting molecule 74 | MQAYLQQSGAELVRPGASVKMSCKASGYTFTSYNMHWVKQ TPRQGLEWIGAIYPGNGDTSYNQKFKGKATLTVDKSSSTAYM QLSSLTSEDSAVYFCARVVYYSNSYWYFDVWGTGTTVTVSG STSGSGKPGSGEGSQIVLSQSPAILSASPGEKVTMTCRASSSVS YMHWYQQKPGSSPKPWIYAPSNLASGVPARFSGSGSGTSYSL TISRVEAEDAATYYCQQWSFNPPTFGAGTKLELKSEFPKPSTP PGSSGGAPGILGFVFTLAEFTLDFSTAKTYVDSLNVIRSAIGTP LQTISSGGTSLLMIDSGIGDNLFAVDILGFDFTIGRFNNLRLIVE RNNLYVTGFVNRTNNVFYRFADFSHVTFPGTTAVTLSADSSY TTLQRVAGISRTGMQINRHSLTTSYLDLMSHSATSLTQSVARA MLRFVTVTAEALRFRQIQRGFRTTLDDLSGRSYVMTAEDVDL TLNWGRILSSVLPDYHGQDSVRVGRISFGSINAILGSVALILNSH HHASAVAA |
| SEQ ID NO: 362 | exemplary cell-targeting molecule 75 | ASVSDVPRDLEVVAATPTSLLISWCRQRCADSYRITYGETGGN SPVQEFTVPGSWKTATISGLKPGVDYTITVYVVTHYYGWDRY SHPISINYRTGSEFPKRSTPPGSSGGAPGILGFVFTLAEFTLDFST AKTYVDSLNVIRSAIGTPLQTISSGGTSLLMIDSGIGDNLFAVDI LGFDFTLGRFNNLRLIVERNNLYVTGFVNRTNNVFYRFADFS HVTFPGTTAVTLSADSSYTTLQRVAGISRTGMQINRHSLTTSY LDLMSHSATSLTQSVARAMLRFVTVTAEALRFRQIQRGFRTT LDDLSGRSYVMTAEDVDLTLNWGRLSSVLPDYHGQDSVRVG RISFGSINAILGSVALILNSHHHASAVAA |
| SEQ ID NO: 363 | exemplary cell-targeting molecule 76 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLAEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLDLMSHSATSLTQSVARA MLRFVTVTAEALRFRQIQRGFRTTLDDLSGRSYVMTAEDVDL TLNWGRLSSVLPDYHGQDSVRVGRISFGSINAILGSVALILNSH HHASAVAACITGDALVALPEGESVRIADIVPGARPNSDNAIDL KVLDRHGNPVLADRLFHSGEHPVYTVRTVEGLRVTGTANHP LLCLVDVAGVPTLLWKLIDEIKPGDYAVIQRSAFSVDCAGFAR GKPEFAPTTYTVGVPGLVRFLEAHHRDPDAQAIADELTDGRF YYAKVASVTDAGVQPVYSLRVDTADHAFITNGFVSHATGLT GLNSGLTTNPGVSAWQVNTAYTAGQLVTYNGKTYKCLQPHT SLAGWEPSNVPALWQLQ |
| SEQ ID NO: 364 | exemplary cell-targeting molecule 77 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTGAGTKLELKEFPKPSTP PGSSGGAPGILGFVFTLAEFTLDFSTAKTYVDSLNVIRSAIGTP LQTISSGGTSLLMIDSGIGDNLFAVDILGFDFTLGRFNNLRLIVE RNNLYVTGFVNRTNNYFYRFADFSHVTFPGTTAVTLSADSSY TTLQRVAGISRTGMQINRHSLTTSYLDLMSHSATSLTQSVARA MLRFVTVTAEALRFRQIQRGFRTTLDDLSGRSYVMTAEDVDL TLNWGRLSSVLPDYHGQDSVRVGRISFGSINAILGSVALILNSH HHASAVAACITGDALVALPEGESVRIADIVPGARPNSDNAIDL KVLDRHGNPVLADRLFHSGEHPVYTVRTVEGLRVTGTANHP LLCLVDVAGVPTLLWKLIDEIKPGDYAVIQRSAFSVDCAGFAR GKPEFAPTTYTVGVPGLVRFLEAHHRDPDAQAIADELTDGRF YYAKVASVTDAGVQPVYSLRVDTADHAFITNGFVSHATGLT GLNSGLTTNPGVSAWQVNTAYTAGQLVTYNGKTYKCLQPHT SLAGWEPSNVPALWQLQ |
| SEQ ID NO: 365 | exemplary cell-targeting molecule 78 | MQVQLQQPGAELVKPGASVKMSCKTSGYTFTSYNVMWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY |

| | Sequence Listing | |
|---|---|---|
| ID Number | Text Description | Biological Sequence |
| | | SLTISRVEAEDAATYYCQQWISNPPTFGAGTKLELKEFPKPSTP PGSSGGAPGILGFVFTLAEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLDLMSHSATSLTQSVARA MLRFVTCTAEALRFRQIQRGFRTTLDDLSGRSYVMTAEDVDL TLNWGRLSSVLPDYHGQDSVRVGRISFGSINAILGSVALILNSH HHASAVAAKDEL |
| SEQ ID NO: 366 | exemplary cell-targeting molecule 79 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHHASAVAAEFPKPST PPGSSGGAPGILGFVFTLMQVQLQQPGAELVKPGASVKMSCK TSGYTFTSYNVHWVKQTPGQGLEWIGAIYPGNGDTSFNQKFK GKATLTADKSSSTVYMQLSSLTSEDSAVYYCARSNYYGSSYV WFFDVWGAGTTVTVSSGSTSGSGKPGSGEGSQIVLSQSPTILS ASPGEKVTMTCRASSSVSYMDWYQQKPGSSPKPWIYATSNL ASGVPARFSGSGSGTSYSLTISRVEAEDAATYYCQQWISNPPT FGAGTKLELK |
| SEQ ID NO: 367 | exemplary cell-targeting molecule 80 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHHASAVAAEFPKPST PPGSSGGAPGILGFVFTLDIELTQSPSSFSVSLGDRVTITCKASE DIYNRLAWYQQKPGNAPRLLISGATSLETGVPSRFSGSGSGKD YILSITSLQTEDVATYYCQQYWSTPTFGGGTKLEIKGSTSGSG KPGSGEGSKVQLQESGPSLVQPSQRLSITCTVSGFSLISYGVH WVRQSPGKGLEWLGVEWRGGSTDYNAAFMSRLSITKDNSKS QVFFKMNSLQADDTAIYFCAKTLITTGYAMDYWGQGTTVTV SS |
| SEQ ID NO: 368 | exemplary cell-targeting molecule 81 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHHASAVAAEFPKPST PPGSSGGAPGILGFVFTLDIELTQSPSSFSVSLGDRVTITCKASE DIYNRLAWYQQKPGNAPRLLISGATSLETGVPSRFSGSGSGKD YTLSITSLQTEDVATYYCQQYWSTPTFGGGTKLEIKGSTSGSG KPGSGEGSKVQLQESGPSLVQPSQRLSITCTVSGFSLISYGVH WVRQSPGKGLEWLGVIWRGGSTDYNAAFMSRLSITKDNSKS QVFFKMNSLQADDTAIYFCAKTLITTGYAMDYWGQGTTVTV SS |
| SEQ ID NO: 369 | exemplary cell-targeting molecule 82 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHHASAVAAEFPKPST PPGSSGGAPGILGFVFTLDIQMTQSPSSLSASVGDRVTITCRAS QDVNTAVAWYQQKPGKAPKLLIYSASFLYSGVPSRFSGSRSG TDFTLTISSLQPEDFATYYCQQHYTTPPTFGQGTKVEIKRTGST SGSGKPGSGEGSEVQLVESGGGLVQPGGSLRLSCAASGFNIKD TYIHWVRQAPGKGLEWVARIYPTNGYTRYADSVKGRFTISAD TSKNTAYLQMNSLRAEDTAVYYCSRWGGDGFYAMDVWGQ GTLVTVSS |
| SEQ ID NO: 370 | exemplary cell-targeting molecule 83 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHHASAVAAEFPKPST PPGSSGGAPGILGFVFTLDIQMTQSPSSLSASVGDRVTITCRAS QDVNTAVAWYQQKPGKAPKLLIYSASFLYSGVPSRFSGSRSG TDFTLTISSLQPEDFATYYCQQHYTTPPTFGQGTKVEIKRTGST |

Sequence Listing

| ID Number | Text Description | Biological Sequence |
|---|---|---|
| | | SGSGKPGSGEGSEVQLVESGGGLVQPGGSLRLSCAASGFNIKD TYIHWVRQAPGKGLEWVARIYPTNGYTRYADSVKGRFTISAD TSKNTAYLQMNSLRAEDTAVYYCSRWGGDGFYAMDVWGQ GTLVTVSS |
| SEQ ID NO: 371 | exemplary cell-targeting molecule 84 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHHASAVAAEFPKPST PPGSSGGAPGILGFVFTLDIVMTQAAPSIPVTPGESVSISCRSSK SLLNSNGNTYLYWFLQRPGQSPQLLIYRMSNLASGVPDRFSGS GSGTAFTLRISRVEAEDVGVYYCMQHLEYPFTFGAGTKLELK GSTSGSGKPGSGEGSEVQLQQSGPELIKPGASVKMSCKASGYT FTSYVMHWVKQKPGQGLEWIGYINPYNDGTKYNEKFKGKAT LTSDKSSSTAYMELSSLTSEDSAVYYCARGTYYYGSRVFDYW GQGTTLTVSS |
| SEQ ID NO: 372 | exemplary cell-targeting molecule 85 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHHASAVAAEFPKPST PPGSSGGAPGILGFVFTLDIVMTQAAPSIPVTPGESVSISCRSSK SLLNSNGNTYLYWFLQRPGQSPQLLIYRMSNLASGVPDRFSGS GSGTAFTLRISRVEAEDVGVYYCMQHLEYPFTFGAGTKLELK GSTSGSGKPGSGEGSEVQLQQSGPELIKPGASVKMSCKASGYT FTSYVMHWVKQKPGQGLEWIGYINPYNDGTKYNEKFKGKAT LTSDKSSSTAYMELSSLTSEDSAVYYCARGTYYYGSRVFDYW GQGTTLTVSS |
| SEQ ID NO: 373 | exemplary cell-targeting molecule 86 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHHASAVAAEFPKPST PPGSSGGAPGILGFVFTLDIQLTQSPLSLPVTLGQPASISCRSSQ SLVHRNGNTYLHWFQQRPG9SPRLLIYTVSNRFSGVPDRFSGS GSGTDFTLKISRVEAEDVGVYFCSQSSHVPPTFGAGTRLEIKGS TSGSGKPGSGEGSTKGQVQLQQSGSELKKPGASVKVSCKASG YTFTNYGVNWIKQAPGQGLQWMGWINPNTGEPTFDDDFKGR FAFSLDTSVSTAYLQISSLKADDTAVYFCSRSRGKNEAWFAY WGQGTLVTVSS |
| SEQ ID NO: 374 | exemplary cell-targeting molecule 87 | MAEFTLDFSTAKTTVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHHASAVAAEFPKPST PPGSSGGAPGILGFVFTLDIQLTQSPLSLPVTLGQPASISCRSSQ SLVHRNGNTYLHWFQQRPGQSPRLLIYTVSNRFSGVPDRFSGS GSGTDFTLKISRVEAEDVGVYFCSQSSHVPPTFGAGTRLEIKGS TSGSGKPGSGEGSTKGQVQLQQSGSELKKPGASVKVSCKASG YTFTNYGVNWIKQAPGQGLQWMGWINPNTGEPTFDDDFKGR FAFSLDTSVSTAYLQISSLKADDTAVYFCSRSRGKNEAWFAY WGQGTLVTVSS |
| SEQ ID NO: 375 | exemplary cell-targeting molecule 88 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHHASAVAAHHSED PSSKAPKAPGILGFVFTLEVQLVESGGGLVQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |

Sequence Listing

| ID Number | Text Description | Biological Sequence |
|---|---|---|
| SEQ ID NO: 376 | exemplary cell-targeting molecule 89 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPGILGFVFTLEVQLVESGGGINQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |
| SEQ ID NO: 377 | exemplary cell-targeting molecule 90 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYREADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAAHHSED PSSKAPKAPGILGFVFTLEVQLVESGGGLVQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |
| SEQ ID NO: 378 | exemplary cell-targeting molecule 91 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPGILGFVFTLEVQLVESGGGLVQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |
| SEQ ID NO: 379 | exemplary cell-targeting molecule 92 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPGILGFVFTLASVSDVPRDLEVVAATPTSLLISWCR QRCADSYRITYGETGGNSPVQEFTVPGSWKTATISGLKPGVD YTITVYVVTHYYGWDRYSHPISINYRTGS |
| SEQ ID NO: 380 | exemplary cell-targeting molecule 93 | MAEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSATSLTQSVARAMLRFVTVTAEALRFR QIQRGFRTTLDDLSGRSYVMTAEDVDLTLNWGRLSSVLPDYH GQDSVRVGRISFGSINAILGSVALILNSHHASAVAAEFPKPST PPGSSGGAPGILGFVFTLASVSDVPRDLEVVAATPTSLLISWCR QRCADSYRITYGETGGNSPVQEFTVPGSWKTATISGLKPGVD YTITVYVVTHYYGWDRYSHPISINYRTGS |
| SEQ ID NO: 381 | exemplary cell-targeting molecule 94 | VTEHDTLLYKEFTLDFSTAKTYVDSLNVIRSAIGTPLQTISSGG TSLLMIDSGIGDNLFAVDILGFDFTLGRFNNLRLIVERNNLYVT GFVNRTNNVGYRFADFSHVTFPGTTAVTLSADSSYTTLQRVA GISRTGMQINRHSLTTSYLDLMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 382 | exemplary cell-targeting molecule 95 | GLDRNSGNYKEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSGTSLTQSVARAMLRFVTV TAEALRFRQIQRGFRITLDDLSGASYVMTAEDVDLTLNWGRL SSVLPDYHGQDSVRVGRISFGSINAILGSVALILNSHHASAVA AEFPKPSTPPGSSGGAPDIQMTQSPSSLSASVGDRVTITCKASE DIYNRLTWYQQKPGKAPKLLISGATSLETGVPSRFSGSGSGTD |

| ID Number | Text Description | Biological Sequence |
|---|---|---|
| | | FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 383 | exemplary cell-targeting molecule 96 | GVMTRGRLKEFTLDFSTAKTYVDSLNVIRSAIGTPLQTISSGGT SLLMIDSGIGDNLFAVDILGFDFTLGRFNNLRLIVERNNLYVTG FVNRTNNVFYRFADFSHVTFPGTTAVTLSADSSYTTLQRVAGI SRTGMQINRHSLTTSYLDLMSHSGTSLTQSVARAMLRFVTVT AEALRFRQIQRGFRTTLDDLSGASYVMTAEDVDLTLNWGRLS SVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 384 | exemplary cell-targeting molecule 97 | VYALPLKMLKEFTLDFSTAKTYVDSLNVIRSAIGTPLQTISSGG TSLLMIDSGIGDNLFAVDILGFDFTLGRFNNLRLIVERNNLYVT GFVNRTNNCFYRFADFSHVTFPGTTAVTLSADSSYTTLQRVA GISRTGMQINRHSLTTSYLDLMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 385 | exemplary cell-targeting molecule 98 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGSTSGSG KPGSGEGSTKGQVQLQESGPGLVRPSQTLSLTCTVSGFSLTSY GVHWVRQPPGRGLEWIGVMWRGGSTDYNAAFMSRLNITKD NSKNQVSLRLSSVTAADTACAKSMITTGFVMDSWGQGS LVTVSS |
| SEQ ID NO: 386 | exemplary cell-targeting molecule 99 | GILGFVFTLAEFTLDFSTAKTYVDSLNVIRSAIGTPLQTISSGGT SLLMIDSGIGDNLFAVDILGFDFTLGRFNNLRLIVERNNLYVTG FVNRTNNVFYRFADFSHVTFPGTTAVTLSADSSYTTLQRVAGI SRTGMQINRHSLTFSYLDLMSHSATSLTQSVARAMLRFVTVT AEALRFRQIQRGFRTTLDDLSGRSYVMTAEDVDLTLNWGRLS SVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGSTSGSG KPGSGEGSTKGQVQLQESGPGLVRPSQTLSLTCTVSGFSLTSY GVHWVRQPPGRGLEWIGVMWRGGSTDYNAAFMSRLNITKD NSKNQVSLRLSSVTAADTAVYYCAKSMITTGFVMDSWGQGS LVTVS |
| SEQ ID NO: 387 | exemplary cell-targeting molecule 100 | DIQMTQSPSSLSASVGDRVTITCRASQDVNTAVAWYQQKPGK APKLLIYSASFLYSGVPSRFSGSRSGTDFTLTISSLQPEDFATYY CQQHYTTPPTFGQGTKVEIKRTGSTSGSGKPGSGEGSEVQLVE SGGGLVQPGGSLRLSCAASGFNIKDTYIHWVRQAPGKGLEWV ARIYPTNGYTRYADSVKGRFTISADTSKNTAYLQMNSLRAED TAVYYCSRWGGDGFYAMDVWGQGTLVTVSSEFPKPSTPPGS SGGAPGILGFVFTLKEFTLDFSTAKTYVDSLNVIRSAIGTPLQTI SSGGTSLLMIDSGIGDNLFAVDILGFDFTLGRFNNLRLIVERNN LYVTGFVNRTNNVFYRFADFSHVTFPGTTAVTLSADSSYTTL QRVAGISRTGMQINRHSLTTSYLDLMSHSGTSLTQSVARAML RFVTVTAEALRFRQIQRGFRTTLDDLSGASYVMTAEDVDLTL NWGRLSSVLPDYHGQDSVRVGRISFGSINAILGSVALILNSHH HASAVAA |

Sequence Listing

| ID Number | Text Description | Biological Sequence |
|---|---|---|
| SEQ ID NO: 388 | exemplary cell-targeting molecule 101 | QVQLQQPGAELVKPGASVKMSCKTSGYTFTSYNVHWVKQTP GQGLEWIGAIYPGNGDTSFNQKFKGKATLTADKSSSTVYMQL SSLTSEDSAVYYCARSNYYGSSYVWFFDVWGAGTTVTVSSGS TSGSGKPGSGEGSQIVLSQSPTILSASPGEKVTMTCRASSSVSY MDWYQQKPGSSPKPWIYATSNLASGVPARFSGSGSGTSYSLTI SRVEAEDAATYYCQQWISNPPTFGAGTKLELKEFPKPSTPPGS SGGAPGILGFVFTLKEFTLDFSTAKTYVDSLNVIRSAIGTPLQTI SSGGTSLLMIDSGIGDNLFAVDILGFDFTLGRFNNLRLIVERNN LYVTGFVNRTNNVFYRFADFSHVTFPGTTAVTLSADSSYTTL QRVAGISRTGMQINRHSLTTSYLDLMSHSGTSLTQSVARAML RFVTVTAEALRFRQIQRGFRTTLDDLSGASYVMTAEDVDLTL NWGRLSSVLPDYHGQDSVRVGRISFGSINAILGSVALILNSHH HASAVAA |
| SEQ ID NO: 389 | exemplary cell-targeting molecule 102 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSVTEHDTLLY |
| SEQ ID NO: 390 | exemplary cell-targeting molecule 103 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSNLVPMVATV |
| SEQ ID NO: 391 | exemplary cell-targeting molecule 104 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSQYDPVAALF |
| SEQ ID NO: 392 | exemplary cell-targeting molecule 105 | KEFTLDFSTAKTYVDSLNVIRSAIGTPLQTISSGGTSKLLMIDSGI GDNLFAVDILGFDFTLGRFNNLRLIVERNNLYVTGFVNRTNN VFYRFADFSHVTFPGTTAVTLSADSSYTTLQRVAGISKTGMQI NRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSCLGGLLTMV |
| SEQ ID NO: 393 | exemplary cell-targeting molecule 106 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL |

| ID Number | Text Description | Biological Sequence |
|---|---|---|
| | | QPEDIATYYCQQYWSNPYTFGQGTKVEIKGGGGSQVQLQESG<br>PGLVRPSQTLSLTCTVSGFSLTSYGVHWVRQPPGRGLEWIGV<br>MWRGGSTDYNAAFMSRLNITKDNSKNQVSLRLSSVTAADTA<br>VYYCAKSMITTGFVMDSWGQGSLVTVSSILRGSVAHK |
| SEQ ID NO: 394 | exemplary cell-targeting molecule 107 | KEFTLDFSTAKTYVDSLNVIRSAIGTPLQTISSGGTSLLMIDSGI<br>GDNLFAVDILGFDFTLGRFNNLRLIVERNNLYVTGFVNRTNN<br>VFYRFADFSHVTFPGTTAVTLSADSSYTTLQRVAGISRTGMQI<br>NRHSLTTSYLDLMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHASAVAAEFPKPST<br>PPGSSGGAPDIQMTQSPSSLSASVGDRVTITCKASEDIYNRLT<br>WYQQKPGKAPKLLISGATSLETGVPSRFSGSGSGTDFTFTISSL<br>QPEDIATYYCQQYWSNPYTFGQGTKVEIKGSTSGSGRPGSGE<br>GSTKGQVQLQESGPGLVRPSQTLSLTCTVSGFSLTSYGVHWV<br>RQPPGRGLEWIGVMWRGGSTDYNAAFMSRLNITKDNSKNQV<br>SLRLSSVTAADTAVYYCAKSMITTGFVMDSWGQGSLVTVSSN<br>LVPMVATV |
| SEQ ID NO: 395 | exemplary cell-targeting molecule 108 | KEFTLDFSTAKTYVDSLNVIRSAIGTPLQTISSGGTSLLMIDSGI<br>GDNLFAVDILGFDFTLGRFNNLRLIVERNNLYVTGFVNRTNN<br>VFYRFADFSHVTFPGTTAVTLSADSSYTTLQRVAGISRTGMQI<br>NRHSLTTSYLDLMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHASAVAAEFTKPST<br>PPGSSGGAPDIQMTQSPSSLSASVGDRVTITCRASQDVNTAVA<br>WYQQKPGKAPKLLIYSASFLYSGVPSRFSGSRSGTDFTLTISSL<br>QPEDFATYYCQQHYTTPPTFGQGTKVEIKGGGGSEVQLVESG<br>GGLVQPGGSLRLSCAASGFNIKDTYIHWVRQAPGKGLEWVA<br>RIYPTNGYTRYADSVKGRFTISADTSKNTAYLQMNSLRAEDT<br>AVYYCSRWGGDGFYAMDYWGQGTLVTVSSNLVPMVATV |
| SEQ ID NO: 396 | exemplary cell-targeting molecule 109 | KEFTLDFSTAKTYVDSLNVIRSAIGTPLQTISSGGTSLLMIDSGI<br>GDNLFAVDILGFDFTLGRFNNLRLIVERNNLYVTGFVNRTNN<br>VFYRFADFSHVTFPGTTAVTLSADSSYTTLQRVAGISRTGMQI<br>NRHSLTTSYLDLMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHASAVAAEFPKPST<br>PPGSSGGAPEVQLVESGGGLVQPGGSLRLSCAASGFTFSDSWI<br>HWVRQAPGKGLEWVAWISPYGGSTYYADSVKGRFTISADTS<br>KNTAYLQMNSLRAEDTAVYYCARRHWPGGFDYWGQGTLVT<br>VSSGGGGSGGGGSGGGGSGGGGSGGGGSDIQMTQSPSSLSAS<br>VGDRVTITCRASQDVSTAVAWYQQKPCKAPKLLIYSASFLYS<br>GVPSRFSGSGSGTDFTLTISSLQPEDFATYYCQQYLYHPATFG<br>QGTKVEIKGILGFVFTL |
| SEQ ID NO: 397 | exemplary cell-targeting molecule 110 | KEFTLDFSTAKTYVDSLNVIRSAIGTPLQTISSGGTSLLMIDSGI<br>GDNLFAVDILGFDFTLGRFNNLRLIVERNNLYVTGFVNRTNN<br>VFYRFADFSHVTFPGTTAVTLSADSSYTTLQRVAGISRTGMQI<br>NRHSLTTSYLDLMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHASAVAAEFPKPST<br>PPGSSGGAPDIQMTQSPSSLSASVGDRVTITCRASQGISSWIA<br>WYQQKPEKAPKSLIYAASSLQSGVPSRFSGSGSGTDFTLTISSL<br>QPEDFATYYCQQYNSYPYTFGQGTKLEIKGGGGSQVQLVQSG<br>AEVKKPGASVKVSCKASGYTFTSYDVHWVRQAPGQRLEWM<br>GWLHADTGITKFSQKFQGRVTITRDTSASTAYMELSSLRSEDT<br>AVYYCARERIQLWFDYWGQGTLVTVSSNLVPMVATV |
| SEQ ID NO: 398 | exemplary cell-targeting molecule 111 | KEFTLDFSTAKTYVDSLNVIRSAIGTPLQTISSGGTSLLMIDSGI<br>GDNLFAVDILGFDFTLGRFNNLRLIVERNNLYVTGFVNRTNN<br>VFYRFADFSHVTFPGTTAVTLSADSSYTTLQRVAGISRTGMQI<br>NRHSLTTSYLDLMSHSGTSLTQSVARAMLRFVTVTAEALRFR<br>QIQRGFRTTLDDLSGASYVMTAEDVDLTLNWGRLSSVLPDYH<br>GQDSVRVGRISFGSIINAILGSVALILNSHHASAVAAEFPKPST<br>PPGSSGGAPDIQMTQSPSSLSASVGDRVTITCKASEDIYNRLT<br>WYQQKPGKAPKLLISGATSLETGVPSRFSGSGSGTDFTFTISSL<br>QPEDIATYYCQQYWSNPYTFGQGTKVEIKGGGGSQVQLQESG<br>PGLVRPSQTLSLTCTVSGFSLTSYGVHWVRQPPGRGLEWIGV<br>MWRGGSTDYNAAFMSRLNITKDNSKNQVSLRLSSVTAADTA<br>VYYCAKSMITTGFVMDSWGQGSLVTVSSNLVPMVATV |

-continued

Sequence Listing

| ID Number | Text Description | Biological Sequence |
|---|---|---|
| SEQ ID NO: 399 | exemplary cell-targeting molecule 112 | KEFTEDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPQVQLQQPGAELVKPGASVKMSCKTSGYTFTSYN VHWVKQTPGQGLEWIGAIYPGNGDTSFNQKFKGKATLTADK SSSTVYMQLSSLTSEDSAVYYCARSNYYGSSYVWFFDVWGA GTTVTVSSGSTSGSGKPGSGEGSQIVLSQSPTILSASPGEKVTM TCRASSSVSYMDWYQQKPGSSPKPWIYATSNLASGVPARFSG SGSGTSYSLTISRVEAEDAATYYCQQWISNPPTFGAGTKLELK NLVPMVATV |
| SEQ ID NO: 400 | exemplary cell-targeting molecule 113 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPQVQLVQSGAELVKPGASVKMSCKASGYTFTSYN MHWVKQTPGQGLEWIGAIYPGNGDTSYNQKFKGKATLTADK SSSTAYMQLSSLTSEDSAVYYCARAQLRPNYWYFDVWGAGT TVTVSSGGGGSDIVLSQSPAILSASPGEKVTMTCRASSSVSYM HWYQQKPGSSPKPWIYATSNLASGVPARFSGSGSGTSYSLTIS RVEAEDAATYYCQQWISNPPTFGAGTKLELKNLVPMVATV |
| SEQ ID NO: 401 | exemplary cell-targeting molecule 114 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPQVQLQQPGAELVKPGASVKMSCKASGYTFTSYN MHWVKQTPGRGLEWIGAIYPGNGDTSYNQKFKGKATLTADK SSSTAYMQLSSLTSEDSAVYYCARSTYYGGDWYFNVWGAGT TVTVSAGSTSGSGKPGSGEGSTKGQIVLSQSPAILSASPGEKVT MTCRASSSVSYIHWFQQKPGSSPKPWIYATSNLASGVPRFSG SGSGTSYSLTISRVEAEDAATYYCQQWTSNPPTFGGGTKLEIK NLVPMVATV |
| SEQ ID NO: 402 | exemplary cell-targeting molecule 115 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPEVQLVESGGGLVQAGGSLRLSCAASGITFSINTM GWYRQAPGKQRELVALISSIGDTYYADSVKGRITTISRDNAKN TVYLQMNSLKPEDTAVYYCKRFRTAAQGTDYWGQGTQVTV SSAHHSEDNLVPMVATV |
| SEQ ID NO: 403 | exemplary cell-targeting molecule 116 | KEFTLDFSTAKTYVDSLNVIRSAIGTPLQTISSGGTSLLMIDSGI GDNLFAVDILGFDFTLGRFNNLRLIVERNNTVTGFVNRTNN VFYRFADFSHVTFPTGTTAVTLSADSSYTTLQRVAGISRTGMQI NRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPDIELTQSPSSFSVSLGDRVTITCKASEDIYNRLAW YQQKPGNAPRLLISGATSLETGVPSRFSGSGSGKDYTLSITSLQ TEDVATYYCQQYWSTPTFGGGTKLEIKGSTSGSGKPGSGEGS KVQLQESGPSLVQPSQRLSITCTVSGFSLISYGVHWVRQSPGK GLEWLGVIWRGGSTDYNAAFMSRLSITKDNSKSQVFFKMNSL QADDTAIYTCAKTLITTGYAMDYWGQGTTVTVSSNLVPMVA TV |
| SEQ ID NO: 404 | exemplary cell-targeting molecule 117 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAAHHSED PSSKAPKAPEVQLVESGGGLVQAGGSLRLSCAASGITFSINTM GWYRQAPGKQRELVALISSIGDTYYADSVKGRFTISRDNAKN |

| ID Number | Text Description | Biological Sequence |
|---|---|---|
| | | TVYLQMNSLKPEDTAVYYCRRFRTAAQGTDYWGQGTQVTV<br>SSNLVPMVATV |
| SEQ ID<br>NO: 405 | exemplary<br>cell-targeting<br>molecule 118 | KEFTLDFSTAKTYVDSLNVIRSAIGTPLQTISSGGTSLLMIDSGI<br>GDNLFAVDILGFDFTLGRFNNLRLIVERNNLYVTGFVNRTNN<br>VFYRFADFSHVTFPGTTAVTLSADSSYTTLQRVAGISRTGMQI<br>NRHSLTTSYLDLMSHSGTSLTQSVARAMLRFVTVTADALRFR<br>QIQRGFRTTLDDLSGASYVMTAEDVDLTLNWGRLSSVLPDYH<br>GQDSVRVGRISFGSINAILGSVALILNSHHASAVAAEFPKPST<br>PPGSSGGAPASVSDVPRDLEVVAATPTSLLISWCRQRCADSYR<br>ITYGETGGNSPVQEFTVPGSWKTATISGLKPGVDYTITVYVVT<br>HYYGWDRYSHPISINYRTGSNLVPMVATV |
| SEQ ID<br>NO: 406 | exemplary<br>cell-targeting<br>molecule 119 | ASVSDVPRDLEVVAATPTSLLISWCRQRCADSYRITYGETGGN<br>SPVQEFTVPGSWKTATISGLKPGVDYTITVYVVTHYYGWDRY<br>SHPISINYRTGSEFPKPSTPPGSSGGAPKEFTLDFSTAKTYVDSL<br>NVIRSAIGTPLQTISSGGTSLLMIDSGIGDNLFAVDILGFDFTLG<br>RFNNLRLIVERNNLYVTGFVNRTNNVFYRFADFSHVTFPGTT<br>AVTLSADSSYTTLQRVAGISRTGMQINRHSLTTSYLDLMSHSG<br>TSLTQSVARAMLRFVTVTAEALRFRQIQRGFRTTLDDLSGASY<br>VMTAEDVDLTLNWGRLSSVLPDYHGQDSVRVGRISFGSINAI<br>LGSVALILNCHHASAVAAANLVPMVATV |
| SEQ ID<br>NO: 407 | exemplary<br>cell-targeting<br>molecule 120 | KEFTLDFSTAKTYVDSLNVIRSAIGTPLQTISSGGTSLLMIDSGI<br>GDNLFAVDILGFDFTLGRFNNLRLIVERNNLYVTGFVNRTNN<br>VFYRFADFSHVTFPGTTAVTLSADSSYTTLQRVAGISRTGMQI<br>NRHSLTTSYLDLMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHASAVAAEFPKPST<br>PPGSSGGAPDIVLTQSPASLAVSLGQRATISCRATESVEYYGTS<br>LVQWYQQKPGQPPKLLIYAASSVDSGVPARFSGSGSGTDFSLT<br>IHPVEEDDIAMYFCQQSRRVPYTFGGGTKLEIKGGGGSEVQLQ<br>QSGPELVKPGASVKMSCKASGYTFTSYVMHWVKQKPGQGLE<br>WIGYVNPFNDGTKYNEMFKGKATLTSDKSSSTAYMELSSLTS<br>EDSAVYYCARQAWGYPWGQGTLVTVSANLVPMVATV |
| SEQ ID<br>NO: 408 | exemplary<br>cell-targeting<br>molecule 121 | NLVPMVATVKEFTLDFSTAKTYVDSLNVIRSAIGTPLQTISSGG<br>TSLLMIDSGIGDNLFAVDILGFDFTLGRFNNLRLIVERNNLYVT<br>GFVNRTNNVFYRFADFSHVTFPGTTAVTLSADSSYTTLQRVA<br>GISRTGMQINRHSLTTSYLDLMSHSGTSLTQSVARAMLRFVTV<br>TAEALRFRQIQRGFRTTLDDLSGASYVMTAEDVDLTLNWGRL<br>SSVLPDYHGQDSVRVGRISFGSINAILGSVALILNSHHASAVA<br>AGGGGSGGDIQMTQSPSSLSASVGDRVTITCKASEDIYNRLTW<br>YQQKPGKAPKILLISGATSLETGVPSRFSGSGSGTDFTFTISSLQ<br>PEDIATYYCQQYWSNPYTFGQGTKVEIKGGGGSQVQLQESGP<br>GLVRPSQTLSLTCTVSGFSLTSYGVHWVRQPPGRGLEWIGVM<br>WRGGSTDYNAAFMSRLNITKDNSKNQVSLRLSSVTAADTAV<br>YYCAKSMITTGFVMDSWGQGSLVTVSS |
| SEQ ID<br>NO: 409 | exemplary<br>cell-targeting<br>molecule 122 | NLVPMVATVKEFTLDFSTAKTYVDSLNVIRSAIGTPLQTISSGG<br>TSLLMIDSGIGDNLFAVDILGFDFTLGRFNNLRLIVERNNLYVT<br>GFVNRTNNVFYRFADFSHVTFPGTTAVTLSADSSYTTLQRVA<br>GISRTGMQINRHSLTTSYLDLMSHSGTSLTQSVARAMLRFVTV<br>TAEALRFRQIQRGFRTTLDDLSGASYVMTAEDVDLTLNWGRL<br>SSVLPDYHGQDSVRVGRISFGSINAILGSVALILNSHHASAVA<br>AEFPKPSTPPGSSGGAPDIQMTQSPSSLSASVGDRVTITCKASE<br>DIYNRLTWYQQKPGKAPKLLISGATSLETGVPSRFSGSGSGTD<br>FTFTISSLQPEDIATYYCQQYWSNPYTFGQGTKVEIKGSTSGSG<br>KPGSGEGSTKGQVQLQESGPGLVRPSQTLSLTCTVSGFSLTSY<br>GVHWVRQPPGRGLEWIGVMWRGGSTDYNAAFMSRLNITKD<br>NSKNQVSLRLSSVTAADTAVYYCAKSMITTGFVMDSWGQGS<br>LVTVSS |
| SEQ ID<br>NO: 410 | exemplary<br>cell-targeting<br>molecule 123 | NLVPMVATVKEFTLDFSTAKTYVDSLNVIRSAIGTPLQTISSGG<br>TSLLMIDSGIGDNLFAVDILGFDFTLGRFNNLRLIVERNNLYVT<br>GFVNRTNNVFYRFADFSHVTFPGTTAVTLSADSSYTTLQRVA<br>GISRTGMQINRHSLTTSYLDLMSHSGTSLTQSVARAMLRFVTV<br>TAEALRFRQIQRGFRTTLDDLSGASYVMTAEDVDLTLNWGRL<br>SSVLPDYHGQDSVRVGRISFGSINAILGSVALILNSHHASAVA<br>AEFPKPSTPPGSSGGAPDIQMTQSPSSLSASVGDRVTITCRASQ<br>DVNTAVAWYQQKPGKLLIYSASFLYSGVPSRFSGSRSGT<br>DFTLTISSLQPEDFATYYCQQHYTTPPTFGQGTKVEIKGGGGS<br>EVQLVESGGGLVQPGGSLRLSCAASGFNIKDTYIHWVRQAPG |

Sequence Listing

| ID Number | Text Description | Biological Sequence |
|---|---|---|
| | | KGLEWVARIYPTNGYTRYADSVKGRFTISADTSKNTAYLQM NSLRAEDTAVYYCSRWGGDGFYAMDYWGQGTLVTVSS |
| SEQ ID NO: 411 | exemplary cell-targeting molecule 124 | GILGFVFTLKEFTLDFSTAKTYVDSLNVIRSAIGTPLQTISSGGT SLLMIDSGIGDNLFAVDILGFDFTLGRFNNLRLIVERNNLYVTG FVNRTNNVFYRFADFSHVTFPGTTAVTLSADSSYTTLQRVAGI SRTGMQINRHSLTTSYLDLMSHSGTSLTQSVARAMLRFVTVT AEALRFRQIQRGFRTTLDDLSGASYVMTAEDVDLTLNWGRLS SVLPDYHGQDSVRVGRISFGSINAILGSVALILNSHHHASAVA AEFPKPSTPPGSSGGAPEVQLVESGGGLVQPGGSLRLSCAASG FTFSDSWIHWVRQAPGKGLEWVAWISPYGGSTYYADSVKGR FTISADTSKNTAYLQMNSLRAEDTAVYYCARRHWPGGFDYW GQGTLVTVSSGGGGSGGGGSGGGGSGGGGSDIQMTQ SPSSLSASVGDRVTITCRASQDVSTAVAWYQQKPGKAPKLLIY SASFLYSGVPSRFSGSGSGTDFTLTISSLQPEDFATYYCQQYLY HPATFGQGTKVEIK |
| SEQ ID NO: 412 | exemplary cell-targeting molecule 125 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AGGGGSGGDIQMTQSPSSLSASVGDRVTITCRASQGISSWLA WYQQKPEKAPKSLIYAASSLQSGVPSRFSGSGSGTDFTLTISSL QPEDFATYYCQQYNSYPYTFGQGTKLEIKGGGGSQVQLVQSG AEVKKPGASVKVSCKASGYTFTSYDVHWVRQAPGQRLEWM GWLHADTGITKFSQKFQGRVTITRDTSASTAYMELSSLRSEDT AVYYCARERIQLWFDYWGQGTLVTVSS |
| SEQ ID NO: 413 | exemplary cell-targeting molecule 126 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 414 | exemplary cell-targeting molecule 127 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AEFPKPSTPPGSSGGAPQVQLQQPGAELVKPGASVKMSCKTS GYTFTSYNVHWVKQTPGQGLEWIGALYPNGDTSFNQKFKG KATLTADKSSSTVYMQLSSLTSEDSAVYYCARSNYYGSSYV WFFDVWGAGTTVTVSSGSTSGSGKPGSGEGSQIVLSQSPTILS ASPGEKVTMTCRASSSVSYMDWYQQKPGSSPKPWIYATSNL ASGVPARFSGSGSGTSYSLTISRVEAEDAATYYCQQWISNPPT FGAGTKLELK |
| SEQ ID NO: 415 | exemplary cell-targeting molecule 128 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLDLMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AGGGGSGGQVQLVQSGAELVKPGASVKMSCKASGYTFTSYN MHWVKQTPGQGLEWIGAIYPGNGDTSYNQKFKGKATLTADK SSSTAYMQLSSLTSEDSAVYYCARAQLRPNYWYFDVWGAGT TVTVSSGGGGSGGGGSGGGGSGGGGSGGGGSDIVLSQSPAILS ASPGEKVTMTCRASSSVSYMHWYQQKPGSSPKPWIYATSNL ASGVPARFSGSGSGTSYSLTISRVEAEDAATYYCQQWISNPPT FGAGTKLELK |
| SEQ ID NO: 416 | exemplary cell-targeting molecule 129 | APTSSSTKKTQLQLEHLLLDLQMILNGINNYKNPKLTRMLTFK FYMPKKATELKHLQCLEEELKPLEEVLNLAQSKNFHLRPRDLI SNINVIVLELKGSETTFMCEYADETATIVEFLNRWITFCQSIIST |

| ID Number | Text Description | Biological Sequence |
|---|---|---|
| | | LTEFPKPSTPPGSSGGAPNLVPMVATVKEFTLDFSTAKTYVDS LNVIRSAIGTPLQTISSGGTSLLMIDSGIGDNLFAVDILGFDFTL GRFNNLRLIVERNNLYVTGFVNRTNNVFYRFADFSHVTFPGT TAVTLSADSSYTTLQRVAGISRTGMQINRHSLTTSYLDLMSHS GTSLTQSVARAMLRFVTVTAEALRFRQIQRGFRTTLDDLSGAS YVMTAEDVDLTLNWGRLSSVLPDYHGQDSVRVGRISFGSINA ILGSVALILNSHHHASAVAA |
| SEQ ID NO: 417 | exemplary cell-targeting molecule 130 | GILGFVFTLKEFTLDFSTAKTYVDSLNVIRSAIGTPLQTISSGGT SLLMIDSGIGDNLFAVDILGFDFTLGRFNNLRLIVERNNLYVTG FVNRTNNVFYRFADFSHVTFPGTTAVTLSADSSYTTLQRVAGI SRTGMQINRHSLTTSYLDLMSHSGTSLTQSVARAMLRFVTVT AEALRFRQIQRGFRTTLDDLSGASYVMTAEDVDLTLNWGRLS SVLPDYHGQDSVRVGRISFGSINAILGSVALILNSHHHASAVA AEFPKPSTPPGSSGGAPAPTSSSTKKTQLQLEHLLLDLQMILNG INNYKNPKLTRMLTFKFYMPKKATELKHLQCLEEELKPLEEV LNLAQSKNFHLRPRDLISNINVIVLELKGSETTFMCEYADETA TIVEFLNRWITFCQSIISTLT |
| SEQ ID NO: 418 | exemplary cell-targeting molecule 131 | MNLVPMVATVKEFTLDFSTAKTYVDSLNVIRSAIGTPLQTISS GGTSLLMIDSGIGDNLFAVDILGFDFTLGRFNNLRLIVERNNLY VTGFVNRTNNVFYRFADFSHVTFPGTTAVTLSADSSYTTLQR VAGISRTGMQINRHSLTTSYLDLMSHSGTSLTQSVARAMLRF VTVTAEALRFRQIQRGFRTTLDDLSGASYVMTAEDVDLTLNW GRLSSVLPDYHGQDSVRVGRISFGSINAILGSVALILNSHHHS AVAAEFFKPSTPPGSSGGAPDIQMTQSPSSLSASVGDRVTITCK ASEDIYNRLTWYQQKPGKAPKLLISGATSLETGVPSRFSGSGS GTDFTFTISSLQPEDIATYYCQQYWSNPYTFGQGTKVEIKGSTS GSGKPGSGEGSTKGQVQLQESGPGLVRPSQTLSLTCTVSGFSL TSYGVHWVRQPPGRGLEWIGVMWRGGSTDYNAAFMSRLNIT KDNSKNQVSLRLSSVTAADTAVYYCAKSMITTGFVMDSWGQ GSLVTVSS |
| SEQ ID NO: 419 | exemplary cell-targeting molecule 132 | MNLVPMVATVKEFTLDFSTAKTYVDSLNVIRSAIGTPLQTISS GGTSLLMIDSGIGDNLFAVDILGFDFTLGRFNNLRLIVERNNLY VTGFVNRTNNVFYRFADFSHVTFPGTTAVTLSADSSYTTLQR VAGISRTGMQINRHSLTTSYLDLMSHSGTSLTQSVARAMLRF VTVTAEALRFRQIQRGFRTTLDDLSGASYVMTAEDVDLTLNW GRLSSVLPDYHGQDSVRVGRISFGSINAILGSVALILNSHHHAS AVAAEFPKPSTPPGSSGGAPDIQMTQSPSSLSASVGDRVTITCK ASEDIYNRLTWYQQKPGKAPKLLISGATSLETGVPSRFSGSGS GTDFTFTISSLQPEDIATYYCQQYWSNPYTFGQGTKVEIKGSTS GSGKPGSGEGSTKGQVQLQESGPGLVRPSQTLSLTCTVSGFSL TSYGVHWVRQPPGRGLEWIGVMWRGGSTDYNAAFMSRLNIT KDNSKNQVSLRLSSVTAADTAVYYCAKSMITTGFVMDSWGQ GSLVTVSS |
| SEQ ID NO: 420 | exemplary cell-targeting molecule 133 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGSTSGSGKPGSGE GSTKGQVQLQESGPGLVRPSQTLSLTCTVSGFSLTSYGVHWV RQPPGRGLEWIGVMWRGGSTDYNAAFMSRLNITKDNSKNQV SLRLSSVTAADTAVYYCAKSMITTGFVMDSWGQGSLVTVSSN LVPMVATV |
| SEQ ID NO: 421 | exemplary cell-targeting molecule 134 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGSTSGSGKPGSGE GSTKGQVQLQESGPGLVRPSQTLSLTCTVSGFSLTSYGVHWV RQPPGRGLEWIGVMWRGGSTDYNAAFMSRLNITKDNSKNQV SLRLSSVTAADTAVYYCAKSMITTGFVMDSWGQGSLVTVSSN LVPMVATV |

| | | |
|---|---|---|
| ID Number | Text Description | Biological Sequence |
| SEQ ID NO: 422 | exemplary cell-targeting molecule 135 | MGILGFVFTLKEFTLDFSTAKTYVDSLNVIRSAIGTPLQTISSG GTSLLMIDSGIGDNLFAVDILGFDFTLGRFNNLRLIVERNNLYV TGFVNRTNNVFYRFADFSHVTFPGTTAVTLSADSSYTTLQRV AGISRTGMQINRHSLTTSYLDLMSHSGTSLTQSVARAMLRFVT VTAEALRFRQIQRGFRTTLDDLSGASYVMTAEDVDLTLNWG RLSSVLPDYHGQDSVRVGRISFGSINAILGSVALILNSHHASA VAAEFPKPSTPPGSSGGAPDIQMTQSPSSLSASVGDRVTITCKA SEDIYNRLTWYQQKPGKAPKLLISGATSLETGVPSRFSGSGSG TDFTFTISSLQPEDIATYYCQQYWSNPYTFGQGTKVEIKGSTSG SGKPGSGEGSTKGQVQLQESGPGLVRPSQTLSLTCTVSGFSLT SYGVHWVRQPPGRGLEWIGVMWRGGSTDYNAAFMSRLNIT KDNSKNQVSLRLSSVTAADTAVYYCAKSMITTGFVMDSWGQ GSLVTVSS |
| SEQ ID NO: 423 | exemplary cell-targeting molecule 136 | MDIQMTQSPSSLSASVGDRVTITCTASQDVNTAVAWYQQKP GKAPKLLIYSASFLYSGVPSRFSGSRSGTDFTLTISSLQPEDFAT YYCQQHYTTPPTFGQGTKVEIKRTGSTSGSGKPGSGEGSEVQL VESGGGLVQPGGSLRLSCAASGFNIKDTYIHWVRQAPGKGLE WVARIYPTNGYTRYADSVKGRFTISADTSKNTAYLQMNSLRA EDTAVYYCSRWGGDGFYAMDVWGQGTLVTVSSEFPKPSTPP GSSGGAPGILGFVFTLKEFTLDFSTAKTYVDSLNVIRSAIGTPL QTISSGGTSLLMIDSGIGDNLFAVDILGFDFTLGRFNNLRLIVER NNLYVTGFVNRTNNVFYRFADFSHVTFPGTTAVTLSADSSYT TLQRVAGISRTGMQINRHSLTTSYLDLMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAA |
| SEQ ID NO: 424 | exemplary cell-targeting molecule 137 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLDLMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAA |
| SEQ ID NO: 425 | exemplary cell-targeting molecule 138 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLIDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCRASQDVNTAVA WYQQKPGKAPKLLIYSASFLYSGVPSRFSGSRSGTDFTLTISSL QPEDFATYYCQQHYTTPPTFGQGTKVEIKGGGGSEVQLVESG GGLVQPGGSLRLSCAASGFNIKDTYIHWVRQAPGKGLEWVA RIYPTNGYTRYADSVKGRFTISADTSKNTAYLQMNSLRAEDT AVYYCSRWGGDGFYAMDYWGQGTLVTVSSNLVPMVATV |
| SEQ ID NO: 426 | exemplary cell-targeting molecule 139 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPEVQLVESGGGLVQPGGSLRLSCAASGFTFSDSWI HWVRQAPGKGLEWVAWISPYGGSTYYADSVKGRFTISADTS KNTAYLQMNSLRAEDTAVYYCARRHWPGGFDYWGQGTLVT VSSGGGGSGGGGSGGGGSGGGGSGGGGSDIQMTQSPSSLSAS VGDRVTITCRASQDVSTAVAWYQQKPGKAPKLLIYSASFLYS GVPSRFSGSGSGTDFTLTISSLQPEDFATYYCQQYLHPATFG QGTKVEIKGILGFVFTL |
| SEQ ID NO: 427 | exemplary cell-targeting molecule 140 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR |

| Sequence Listing | | |
|---|---|---|
| ID Number | Text Description | Biological Sequence |
| | | QIQRGFRTTLDDLSGASYVMTAEDVDLTLNWGRLSSVLPDYH GQDSVRVGRISFGSINAILGSVALILNSHHHASAVAAEFPKPST PPGSSGGAPEVQLVESGGGLVQPGGSLRLSCAASGFTFSDSWI HWVRQAPGKGLEWVAWISPYGGSTYYADSVKGRFTISADTS KNTAYLQMNSLRAEDTAVYYCARRHWPGGFDYWGQGTLVT VSSGGGGSGGGGSGGGGSGGGGSGGGGSDIQMTQSPSSLSAS VGDRVTITCRASQDVSTAVAWYQQKPGKAPKLLIYSASFLYS GVPSRFSGSGSGTDFTLTISSLQPEDFATYYCQQYLHPATFG QGTKVEIKGILGFVFTL |
| SEQ ID NO: 428 | exemplary cell-targeting molecule 141 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLIDDLSGASYVMTAEDVDLTLNWGRLSSVLPDYH GQDSVRVGRISFGSINAILGSVALILNSHHHASAVAAEFPKPST PPGSSGGAPDIQMTQSPSSLSASVGDRVITTCRASQGISSWLA WYQQKPEKAPKSLIYAASSLQSGVPSRFSGSGSGTDFTLTISSL QPEDFATYYCQQYNSYPYTFGQGTKLEIKGGGGSQVQLVQSG AEVKKPGASVKVSCKASGYTFTSYDVHWVRQAPGQRLEWM GWLHADTGITKFSQKFQGRVTITRDTSASTAYMELSSLRSEDT AVYYCARERIQLWFDYWGQGTLVTVSSNLVPMVATV |
| SEQ ID NO: 429 | exemplary cell-targeting molecule 142 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSNLVPMVATV |
| SEQ ID NO: 430 | exemplary cell-targeting molecule 143 | QVQLQQPGAELVKPGASVKMSCKTSGYTFTSYNVHWVKQTP GQGLEWIGAIYPGNGDTSFNQKFKGKATLTADKSSSTVYMQL SSLTSEDSAVYYCARSNYYGSSYVWFFDVWGAGTTVTVSSGS TSGSGKPGSGEGSQIVLSQSPTILSASPGEKVTMTCRASSSVSY MDWYQQKPGSSPKPWIYATSNLASGVPARFSGSGSGTSYSLTI SRVEAEDAATYYCQQWISNPPTFGAGTKLELKEFPKPSTPPGS SGGAPGILGFVFTLKEFTLDFSTAKTYVDSLNVIRSAIGTPLQTI SSGGTSLLMIDSGIGDNLFAVDILGFDFTLGRFNNLRLIVERNN LYYTGFVNRTNNVFYRFADFSHVTFPGTTAVTLSADSSYTTL QRVAGISRTGMQINRHSLTTSYLDLMSHSGTSLTQSVARAML RFVTVTAEALRFRQIQRGFRTTLDDLSGASYVMTAEDVDLTL NWGRLSSVLPDYHGQDSVRVGRISFGSINAILGSVALILNSHH HASAVAA |
| SEQ ID NO: 431 | exemplary cell-targeting molecule 144 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLKEFTLDFSTAKTYVDSLNVIRSAIGTP LQTISSGGTSLLMIDSGIGDNLFAVDILGFDFTLGRFNNTRLIVE RNNLYVTGFVNRTNNVFYRFADFSFPVTFPGTTAVTLSADSSY TTLQRVAGISRTGMQINRHSLTTSYLDLMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAA |
| SEQ ID NO: 432 | exemplary cell-targeting molecule 145 | MDIQMTQSPSSLSASVGDRVTITCRASQDVNTAVAWYQQKP GKAPKLLIYSASFLYSGVPSRFSGSRSGTDFTLTISSLQPEDFAT YYCQQHYTTPPTFGQGTKVEIKRTGSTSGSGKPGSGEGSEVQL VESGGGLVQPGGSLRLSCAASGFNIKDTYIHWVRQAPGKGLE WVARIYPTNGYTRYADSVKGRFTISADTSKNTAYLQMNSLRA EDTAVYYCSRWGGDGFYAMDVWGQGTLVTVSSEFPKPSTPP GSSGGAPGILGFVFTLKEFTLDFSTAKTYVDSLNVIRSAIGTPL QTISSGGTSLLMIDSGIGDNLFAVDILGFDFTLGRFNNLRLIVER NNLYVTGFVNRTNNVFYRFADFSHVTFPGTTAVTLSADSSYT TLQRVAGISRTGMQINRHSLTTSYLDLMSHSGTSLTQSVARA |

| ID Number | Text Description | Biological Sequence |
|---|---|---|
| | | MLRFVTVTAEALRFRQIQRGFRTTLDDLSGASYVMTAEDVDL TLNWGRLSSVLPDYHGQDSVRVGRISFGSINAILGSVALILNSH HHASAVAAKDEL |
| SEQ ID NO: 433 | exemplary cell-targeting molecule 146 | MDIQMTQSPSSLSASVGDRVTITCRASQDVNTAVAWYQQKP GKAPKLLIYSASFLYSGVPSRFSGSRSGTDFTLTISSLQPEDFAT YYCQQHYTFPPTFGQGTKVEIKRTGSTSGSGKPGSGEGSEVQL VESGGGLVQPGGSLRLSCAASGFNIKDTYIHWVRQAPGKGLE WVARIYPTNGYTRYADSVKGRFTISADTSKNTAYLQMNSLRA EDTAVYYCSRWGGDGFYAMDVWGQGTLVTVSSEFPKPSTPP GSSGGAPGILGFVFTLKEFTLDFSTAKTYVDSLNVIRSAIGTPL QTISSGGTSLLMIDSGIGDNLFAVDILGFDFTLGRFNNLRLIVER NNLYVTGFVNRTNNVFYRFADFSHVTFPGTTAVTLSADSSYT TLQRVAGISRTGMQINRHSLTTSYLDLMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAAKDEL |
| SEQ ID NO: 434 | exemplary cell-targeting molecule 147 | MDIELTQSPSSFSVSLGDRVTITCKASEDIYNRLAWYQQKPGN APRLLISGATSLETGVPSRFSGSGSGKDYTLSITSLQTEDVATY YCQQYWSTPTFGGGTKLEIKGSTSGSGKPGSGEGSKVQLQES GPSLVQPSQRLSITCTVSGFSLISYGVHWVRQSPGKGLEWLGV IWRGGSTDYNAAFMSRLSITKDNSKSQVFFKMNSLQADDTAI YFCAKTLITTGYAMDYWGQGTTVTVSSEFPKPSTPPGSSGGAP GILGFVFTLKEFTLDFSTAKTYVDSLNVIRSAIGTPLQTISSGGT SLLMIDSGIGDNLFAVDILGFDFTLGRFNNLRLIVERNNLYVTG FVNRTNNVFYRFADFSHVTFPGTTAVTLSADSSYTTLQRVAGI SRTGMQINRHSLTTSYLDLMSHSGTSLTQSVARAMLRFVTVT AEALRFRQIQRGFRTTLDDLSGASYVMTAEDVDLTLNWGRLS SVLPDYHGQDSVRVGRISFGSINAILGSVALILNSHHHASAVA AKDEL |
| SEQ ID NO: 435 | exemplary cell-targeting molecule 148 | MDIELTQSPSSFSVSLGDRVTITCKASEDIYNRLAWYQQKPGN APRLLISGATSLETGVPSRFSGSGSGKDYTLSITSLQTEDVATY YCQQYWSTPTFGGGTKLEIKGSTSGSGKPGSGEGSKVQLQES GPSLVQPSQRLSITCTVSGFSLISYGVHWVRQSPGKGLEWLGV IWRGGSTDYNAAFMSRLSITKDNSKSQVFFKMNSLQADDTAI YFCAKTLITTGYAMDYWGQGTTVTVSSEFPKPSTPPGSSGGAP GILGFVFTLKEFTLDFSTAKTYVDSLNVIRSAIGTPLQTISSGGT SLLMIDSGIGDNLFAVDILGFDFTLGRFNNLRLIVERNNLYVTG FVNRTNNVFYRFADFSHVTFPGTTAVTLSADSSYTTLQRVAGI SRTGMQINRHSLTTSYLDLMSHSGTSLTQSVARAMLRFVTVT AFALRFRQIQRGFRTTLDDLSGASYVMTAEDVDLTLNWGRLS SVLPDYHGQDSVRVGRISFGSINAILGSVALILNSHHHASAVA AKDEL |
| SEQ ID NO: 436 | exemplary cell-targeting molecule 149 | MDIVMTQAAPSIPVTPGESVSISCRSSKSLLNSNGNTYLYWFL QRPGQSPQLLIYRMSNLASGVPDRFSGSGSGTAFTLRISRVEAE DVGVYYCMQHLEYPFTFGAGTKLELKGSTSGSGKPGSGEGSE VQLQQSGPELIKPGASVKMSCKASGYTFTSYVMHWVKQKPG QGLEWIGYINPYNDGTKYNEKFKGKATLTSDKSSSTAYMELS SLTSEDSAVYYCARGTYYYGSRVFDYWGQGTTLTVSSAEFPK PSTPPGSSGGAPGILGFVFTLKEFTLDFSTAKTYVDSLNVIRSAI GTPLQTISSGGTSLLMIDSGIGDNLFAVDILGFDFTLGRFNNLR LIVERNNLYVTGFVNRTNNVFYRFADFSHVTFPGTTAVTLSA DSSYTTLQRVAGISRTGMQINRHSLTTSYLDLMSHSGTSLTQS VARAMLRFVTVTAEALRFRQIQRGFRTTLDDLSGASYVMTAE DVDLTLNWGRLSSVLPDYHGQDSVRVGRISFGSINAILGSVAL ILNSHHHASAVAAKDEL |
| SEQ ID NO: 437 | exemplary cell-targeting molecule 150 | MDIVMTQAAPSIPVTPGESVSISCRSSKSLLNSNGNTYLYWFL QRPGQSPQLLIYRMSNLASGVPDRFSGSGSGTAFTLRISRVEAE DVGVYYCMQHLEYPFTFGAGTKLELKGSTSGSGKPGSGEGSE VQLQQSGPELIKPGASVKMSCKASGYTFTSYVMHWVKQKPG QGLEWIGYINPYNDGTKYNEKFKGKATLTSDKSSSTAYMELS SLTSEDSAVYYCARGTYYYGSRVFDYWGQGTTLTVSSAEFPK PSTPPGSSGGAPGILGFVFTLKEFTLDFSTAKTYVDSLNVIRSAI GTPLQTISSGGTSLLMIDSGIGDNLFAVDILGFDFTLGRFNNLR LIVERNNLYVTGFVNRTNNVFYRFADFSHVTFPGTTAVTLSA DSSYTTLQRVAGISRTGMQINRHSLTTSYLDLMSHSGTSLTQS VARAMLRFVTVTAEALRFRQIQRGFRTTLDDLSGASYVMTAE DVDLTLNWGRLSSVLPDYHGQDSVRVGRISFGSINAILGSVAL ILNSHHHASAVAAKDEL |

| ID Number | Text Description | Biological Sequence |
|---|---|---|
| SEQ ID NO: 438 | exemplary cell-targeting molecule 151 | MDIQLTQSPLSLPVTLGQPASISCRSSQSLVHRNGNTYLHWFQ QRPGQSPRLLIYTVSNRFSGVPDRFSGSGSGTDFTLKISRVEAE DVGVYFCSQSSHVPPTFGAGTRLEIKGSTSGSGKPGSGEGSTK GQVQLQQSGSELKKPGASVKVSCKASGYTFTNYGVNWIKQA PGQGLQWMGWINPNTGEPTFDDDFKGRFAFSLDTSVSTAYLQ ISSLKADDTAVYFCSRSRGKNEAWFAYWGQGTLVTVSSEPPK PSTPPGSSGGAPGILGFVGTLKEFTLDFSTAKTYVDSLNVIRSAI GTPLQTISSGGTSLLMIDSGIGDNLFAVDILGFDFTLGRFNNLR LIVERNNLYVTGFVNRTNNVFYRFADFSHVTFPGTTAVTLSA DSSYTTLQRVAGISRTGMQINRHSLTTSYLDLMSHSGTSLTQS VARAMLRFVTVTAEALRFRQIQRGFRTTLDDLSGASYVMTAE DVDLTLNWGRLSSVLPDYHGQDSVRVGRISFGSINAILGSVAL ILNSHHHNSAVAAKDEL |
| SEQ ID NO: 439 | exemplary cell-targeting molecule 152 | MDIQLTQSPLSLPVTLGQPASISCRSSQSLVHRNGNTYLHWFQ QRPGQSPRLLIYTVSNRFSGVPDRFSGSGSGTDFTLKISRVEAE DVGVYFCSQSSHVPPTFGAGTRLEIKGSTSGSGKPGSGEGSTK GQVQLQQSGSELKKPGASVKVSCKASGYTFTNYGVNWIKQA PGQGLQWMGWINPNTGEPTFDDDFKGRFAFSLDTSVSTAYLQ ISSLKADDTAVYFCSRSRGKNEAWFAYWGQGTLVTVSSEPPK PSTPPGSSGGAPGILGFVFTLKEFTLDFSTAKTYVDSLNVIRSAI GTPLQTISSGGTSLLMIDSGIGDNLFAVDILGFDFTLGRFNNLR LIVERNNLYVTGFVNRTNNVFYRFADFSHVTFPGTTAVTLSA DSSYTTLQRVAGISRTGMQINRHSLTTSYLDLMSHSGTSLTQS VARAMLRFVTVTAEALRFRQIQRGFRTTLDDLSGASYVMTAE DVDLTLNWGRLSSVLPDYHGQDSVRVGRISFGSINAILGSVAL ILNSHHHASAVAAKDEL |
| SEQ ID NO: 440 | exemplary cell-targeting molecule 153 | MEVQLVESGGGLVQAGGSLRLSCAASGFTFSINTMGWYRQAP GKQRELVALISSIGDTYYADSVKGRFTISRDNAKNTVYLQMN SLKPEDTAVYYCKRFRTAAQGTDYWGQGTQVTVSSAHHSED PSSKAPKAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLDLMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAAKDEL |
| SEQ ID NO: 441 | exemplary cell-targeting molecule 154 | MEVQLVESGGGLVQAGGSLRLSCAASGITFSINTMGWYRQAP GKQRELVALISSIGDTYYADSVKGRFTISRDNAKNTVYLQMN SLKPEDTAVYYCKRFRTAAQGTDYWGQGTQVTVSSEPPKPST PPGSSGGAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFTGTTAVTLSADSSY TTLQRVAGISRTGMQINRHSLTTSYLDLMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAAKDEL |
| SEQ ID NO: 442 | exemplary cell-targeting molecule 155 | MEVQLVESGGGLVQAGGSLRLSCAASGITFSINTMGWYRQAP GKQRELVALISSIGDTYYADSVKGRFTISRDNAKNTVYLQMN SLKPEDTAVYYCKRFRTAAQGTDYWGQGTQVTVSSAHHSED PSSKAPKAPGILGFVFTLGILGFVFTLKEFTLDFSTAKTYVDSL NVIRSAIGTPLQTISSGGTSLLMIDSGIGDNLFAVDILGFDFTLG RFNNLRLIVERNNLYVTGFVNRTNNVFYRFADFSHVTFPGTT AVTLSADSSYTTLQRVAGISRTGMQINRHSLTTSYLDLMSHSG TSLTQSVARAMLRFVTVTAEALRFRQIQRGFRTTLDDLSGASY VMTAEDVDLTLNWGRLSSVLPDYHGQDSVRVGRISFGSINAI LGSVALILNSHHHASAVAAKDEL |
| SEQ ID NO: 443 | exemplary cell-targeting molecule 156 | MEVQLVESGGGLVQAGGSLRLSCAASGITFSINTMGWYRQAP GKQRELVALISSIGDTYYADSVKGRFTISRDNAKNTVYLQMN SLKPEDTAVYYCKRFRTAAQGTDYWGQGTQVTVSSEPPKPST PPGSSGGAPGILGFVFTLGILGFVFTLKEFTLDFSTAKTYVDSL NVIRSAIGTPLQTISSGGTSLLMIDSGIGDNLFAVDILGFDFTLG RFNNLRLIVERNNLYVTGFVNRTNNVFYRFADFSHVTFPGTT AVTLSADSSYTTLQRVAGISRTGMQINRHSLTTSYLDLMSHSG TSLTQSVARAMLRFVTVTAEALRFRQIQRGFRTTLDDLSGASY VMTAEDVDLTLNWGRLSSVLPDYHGQDSVRVGRISFGSINAI LGSVALILNSHHHASAVAAKDEL |

Sequence Listing

| ID Number | Text Description | Biological Sequence |
|---|---|---|
| SEQ ID NO: 444 | exemplary cell-targeting molecule 157 | MAPTSSSTKKTQLQLEHLLLDLQMILNGINNYKNPKLTRMLT FKFYMPKKATELKHLQCLEEELKPLEEVLNLAQSKNFHLRPR DLISNINVIVLELKGSETTFMCEYADETATIVEFLNRWITFCQSI ISTLTEFPKPSTPPGSSGGAPGILGFVFTLKEFTLDFSTAKTYVD SLNVIRSAIGTPLQTISSGGTSLLMIDSGIGDNLFAVDILGFDFT LGRFNNLRLIVERNNLYVTGFVNRTNNVFYRFADFSHVTFPG TTAVTLSADSSYTTLQRVAGISRTGMQINRHSLTTSYLDLMSH SGTSLTQSVARAMLRFVTVTAEALRFRQIQRGFRTTLDDLSGA SYVMTAEDVDLTLNWGRLSSVLPDYHGQDSVRVGRISFGSIN AILGSVALILNSHHHASAVAAKDEL |
| SEQ ID NO: 445 | exemplary cell-targeting molecule 158 | MAPTSSSTKKTQLQLEHLLLDLQMILNGINNYKNPKLTRMLT FKFYMPKKATELKHLQCLEEELKPLEEVLNLAQSKNFHLRPR DLISNINVIVLELKGSETTFMCEYADETATIVEFLNRWITFCQSI ISTLTEFPKPSTPPGSSGGAPGILGFVFTLKEFTEDFSTAKTYVD SLNVIRSAIGTPLQTISSGGTSLLMIDSGIGDNLFAVDILGFDFT LGRFNNLRLIVERNNLYVTGFVNRTNNVFYRFADFSHVTFPG TTAVTLSADSSYTTLQRVAGISRTGMQINRHSLTTSYLDLMSH SGTSLTQSVARAMLRFVTVTAEALRFRQIQRGFRTTLDDLSGA SYVMTAEDVDLTLNWGRLSSVLPDYHGQDSVRVGRISFGSIN AILGSVALILNCHHASAVAAKDEL |
| SEQ ID NO: 446 | exemplary cell-targeting molecule 159 | MQVQLVQSGAELVKPGASVKMSCKASGYTFTSYNMHWVKQ TPGQGLEWIGAIYPGNGDTSYNQKFKGKATLTADKSSSTAYM QLSSLTSEDSAVYYCARAQLRPNYWYFDVWGAGTTVTVSSG STSGSGKPGSGEGSDIVLSQSPAILSASPGEKVTMTCRASSSVS YMHWYQQKPGSSPKPWIYATSNLASGVPARFSGSGSGTSYSL TISRVEAEDAATYYCQQWISNPPTFGAGTKLELKEFPKPSTPP GSSGGAPGILGFVFTLKEFTLDFSTAKTYVDSLNVIRSAIGTPL QTISSGGTSLLMIDSGIGDNLFAVDILGFDFTLGRFNNLRLIVER NNLYVTGFVNRTNNVFYRFADFSHVTFPGTTAVTLSADSSYT TLQRVAGISRTGMQINRHSLTTSYLDLMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAA |
| SEQ ID NO: 447 | exemplary cell-targeting molecule 160 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TFLQRVAGISRTGMQINRHSLTTSYLDLMSHSGTSLTQSVARA MLRFVTVTAEALRERQIQRGFRTTLDDLSGASYVMTAEDVDL TLNWGRLSSVLPDYHGQDSVRVGRISFGSINAILGSVALILNSH HHASAVAA |
| SEQ ID NO: 448 | exemplary cell-targeting molecule 161 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLDLMSHSGTSLTQSVARA MLRFVTVTAEALRERQIQRGFRTTLDDLSGASYVMTAEDVDL TLNTWGRLSSVLPDYHGQDSVRVGRISFGSINAILGSVALILNSH HHASAVAA |
| SEQ ID NO: 449 | exemplary cell-targeting molecule 162 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEEPKPSTP PGSSGGAPGILGFVFTLKEFTLDFSTAKTYVDSLNVIRSAIGTP LQTISSGGTSLLMIDSGIGDNLFAVDILGFDITLGRFNNLRLIVE RNNLYVTGFVNRTNNVFYRFADFSHVTFPGTTAVTLSADSSY TTLQRVAGISRTGMQINRHSLTTSYLDLMSHSGTSLTQSVARA |

-continued

| | Sequence Listing | |
|---|---|---|
| ID Number | Text Description | Biological Sequence |
| | | MLRFVTVTAEALRFRQIQRGFRTTLDDLSGASYVMTAEDVDL TLNWGRLSSVLPDYHGQDSVRVGRISFGSINAILGSVALILNSH HHASAVAA |
| SEQ ID NO: 450 | exemplary cell-targeting molecule 163 | MQVQLQQPGAELVKPGASVKMSCKASGYTFTSYNMHWVKQ TPGRGLEWIGAIYPGNGDTSYNQKFKGKATLTADKSSSTAYM QLSSLTSEDSAVYYCARSTYYGGDWYFNVWGAGTTVTSAG STSGSGKPGSGEGSTKGQIVLSQSPAILSASPGEKVTMTCRASS SVSYIHWFQQKPGSSPKPWIYATSNLASGVPVRFSGSGSGTSY SLTISRVEAEDAATYYCQQWTSNPPTFGGGTKLEIKEFPKPSTP PGSSGGAPGILGFVFTLKEFTLDFSTAKTYVDSLNVIRSAIGTP LQTISSGGTSLLMIDSGIGDNLFAVDILGFDFTLGRFNNLRLPVE RNNLYVTGFVNRTNNVFYRFADFSHVTFPGTTAVTLSADSSY TTLQRVAGISRTGMQINRHSLTTSYLDLMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAA |
| SEQ ID NO: 451 | exemplary cell-targeting molecule 164 | MEVQLVESGGGLVQPGRSLRLSCAASGFTFNDYAMHWVRQA PGKGLEWVSTISWNSGSIGYADSVKGRFTISRDNAKKSLYLQ MNSLRAEDTALYYCAKDIQYGNYYYGMDVWGQGTTVTVSS GSTSGSGKPGSGEGSEIVLTQSPATLSLSPGERATLSCRASQSV SSYLAWYQQKPGQAPRLLIYDASNRATGIPARFSGSGSGTDFT LTISSLEPEDFAVYYCQQRSNWPITFGQGTRLEIKEFPKPSTPPG SSGGAPGILGFVFTLKEFTLDFSTAKTYVDSLNVIRSAIGTPLQ TISSGGTSLLMIDSGIGDNLFAVDILGFDFTLGRFNNLRLIVERN NLYVTGFVNRTNNVFYRFADFSHVTFPGTTAVTLSADSSYTT LQRVAGISRTGMQINRHSLTTSYLDLMSHSGTSLTQSVARAM LRFVTVTAEALRFRQIQRGFRTTLDDLSGASYVMTAEDVDLT LNWGRLSSVLPDYHGQDSVRVGRISFGSINAILGSVALILNSH HHASAVAA |
| SEQ ID NO: 452 | exemplary cell-targeting molecule 165 | MEIVLTQSPATLSLSPGERATLSCRASQSVSSYLAWYQQKPGQ APRLLIYDASNRATGIPARFSGSGSGTDFTLTISSLEPEDFAVY YCQQRSNWPITTGQGTRLEIKGGGGSGGGGSGGGGSGGGGSG GGGSEVQLVESGGGLVQPGRSLRLSCAASGFTFNDYAMHWV RQAPGKGLEWVSTISWNSGSIGYADSVKGRFTISRDNAKKSL YLQMNSLRAEDTALYYCAKDIQYGNYYYGMDVWGQGTTVT VSSEFPKPSTPPGSSGGAPGILGFVFTLKEFTLDFSTAKTYVDS LNVIRSAIGTPLQTISSGGTSLLMIDSGIGDNLFAVDILGFDFTL GRFNNLRLIVERNNLYVTGFVNRTNNVFYRFADFSHVTFPGT TAVTLSADSSYTTLQRVAGISRTGMQINRHSLTTSYLDLMSHS GTSLTQSVARAMLRFVTVTAEALRFRQIQRGFRTTLDDLSGAS YVMTAEDVDLTLNWGRLSSVLPDYHGQDSVRVGRISFGSINA ILGSVALILNSHHHASAVAA |
| SEQ ID NO: 453 | exemplary cell-targeting molecule 166 | MQIVLSQSPAILSASPGEKVTMTCRASSSVSYMHWYQQKPGS SPKPWIYAPSNLASGVPARFSGSGSGTSYSLTISRVEAEDAATY YCQQWSFNPPTFGAGTKLELKSGGGGSGGGGSGGGGSGGGG SGGGGSQAYLQQSGAELVRPGASVKMSCKASGYTFTSYNMH WVKQTPRQGLEWIGAIYPGNGDTSYNQKFKGKATLTVDKSSS TAYMQLSSLTSEDSAVYFCARVVYYSNSYWYFDVWGTGTTV TVSEFPKPSTPPGSSGGILGFVFTLGAPKEFTLDFSTAKTYVDS LNVIRSAIGTPLQTISSGGTSLLMIDSGIGDNLFAVDILGFDFTL GRFNNLRLIVERNNLYVTGFVNRTNNVFYRFADFSHVTFPGT TAVTLSADSSYTTLQRVAGISRTGMQINRHSLTTSYLDLMSHS GTSLTQSVARAMLRFVTVTAEALRFRQIQRGFRTTLDDLSGAS YVMTAEDVDLTLNWGRLSSVLPDYHGQDSVRVGRISFGSINA ILGSVALILNSHHHASAVAA |
| SEQ ID NO: 454 | exemplary cell-targeting molecule 167 | MQAYLQQSGAELVRPGASVKMSCKASGYTFTSYNMHWVKQ TPRQGLEWIGAIYPGNGDTSYNQKFKGKATLTVDKSSSTAYM QLSSLTSEDSAVYFCARVVYYSNSYWYPDVWGTGTTVTVSG STSGSGKPGSGEGSQIVLSQSPAILSASPGEKVTMTCRASSSVS YMHWYQQKPGSSPKPWIYAPSNLASGVPARFSGSGSGTSYSL TISRVEAEDAATYYCQQWSFNPPTFGAGTKLELKSEFPKPSTP PGSSGGAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLDLMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAA |

| | | |
|---|---|---|
| SEQ ID NO: 455 | exemplary cell-targeting molecule 168 | ASVSDVPRDLEVVAATPTSLLISWCRQRCADSYRITYGETGGN SPVQEFTVPGSWKTATISGLKPGVDYTITVYVVTHYYGWDRY SHPISINYRTGSEFPKPSTPPGSSGGAPGILGFVFTLKEFTLDFST AKTYVDSLNVIRSAIGTPLQTISSGGTSLLMIDSGIGDNLFAVDI LGFDFTLGRFNNLRLIVERNNLYVTGFVNRTNNVFYRFADFS HVTFPGTTAVTLSADSSYTTLQRVAGISRTGMQINRHSLTTSY LDLMSHSGTSLTQSVARAMLRFVTVTAEALRFRQIQRGFRTT LDDLSGASYVMTAEDVDLTLNWGRLSSVLPDYHGQDSVRVG RISFGSINAILGSVALILNSHHASAVAA |
| SEQ ID NO: 456 | exemplary cell-targeting molecule 169 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLDLMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAACITGDALVALPEGESVRIADIVPGARPNSDNAIDL KVLDRHGNPVLADRLFHSGEHPVYTVRTVEGLRVTGTANHP LLCLVDVAGVPTLLWKLIDEIKPGDYAVIQRSAFSVDCAGFAR GKPEFAPTTYTVGVPGLVRFLEAHHRDPDAQAIADELTDGRF YYAKVASVTDAGVQPVYSLRVDTADHAFITNGFVSHATGLT GLNSGLTTNPVSAWQVNTAYTAGQLVTYNGKTYKCLQPHT SLAGWEPSNVPALWQLQ |
| SEQ ID NO: 457 | exemplary cell-targeting molecule 170 | MQVQLQQPGAELVKPGASVKMSCKTSGYTFTSYNVHWVKQ TPGQGLEWIGAWPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLDLMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAACITGDALVALPEGESVRIADIVPGARPNSDNAIDL KVLDRHGNPVLADRLFHSGEHPVYTVRTVEGLRVTGTANHP LLCLVDVAGVPTLLWKLIDEIKPGDYAVIQRSAFSVDCAGFAR GKPEFAPTTYTVGVPGLVRFLEAHHRDPDAQAIADELTDGRF YYAKVASVTDAGVQPVYSLRVDTADHAFITNGFVSHATGLT GLNSGLTTNPVSAWQVNTAYTAGQLVTYNGKTYKCLQPHT SLAGWEPSNVPALWQLQ |
| SEQ ID NO: 458 | exemplary cell-targeting molecule 171 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYCWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLKEFTLDFSTAKTYVDSLNVIRSAIGTP LQTISSGGTSLLMIDSGIGDNLIAVDILGFDFTLGRFNNLRLIVE RNNLYVTGFVNRTNNVFYRFADFSHVTFPGTTAVTLSADSSY TTLQRVAGISRTGMQINRHSLTTSYLDLMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAAKDEL |
| SEQ ID NO: 459 | exemplary cell-targeting molecule 172 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLMQVQLQQPGAELVKPGASVKMSCK TSGYTFTSYNHHWVKQTPGQGLEWIGAIYPGNGDTSFNQKFK GKATLTADKSSSTVYMQLSSLTSEDSAVYYCARSNYYGSSYV WFFDVWGAGTTVTVSSGSTSGSGKPGSGEGSQIVLSQSPTILS |

| ID Number | Text Description | Biological Sequence |
|---|---|---|
| | | ASPGEKVTMTCRASSSVSYMDWYQQKPGSSPKPWIYATSNL ASGVPARFSGSGSGTSYSLTISRVEAEDAATYYCQQWISNPPT FGAGTKLELK |
| SEQ ID NO: 460 | exemplary cell-targeting molecule 173 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIELTQSPSSFSVSLGDRVTITCKASE DIYNRLAWYQQKPGNAPRLLISGATSLETGVPSRFSGSGSGKD YTLSITSLQTEDVATYYCQQYWSTPTFGGGTKLEIKGSTSGSG KPGSGEGSKVQLQESGPSLVQPSQRLSITCTVSGFSLISYGVH WVRQSPGKGLEWLGVIWRGGSTDYNAAFMSRLSITKDNSKS QVFFKMNSLQADDTAIYFCAKTLITTGYAMDYWGQGTTVTV SS |
| SEQ ID NO: 461 | exemplary cell-targeting molecule 174 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIELTQSPSSFSVSLGDRVTITCKASE DIYNRLAWYQQKPGNAPRLLISGATSLETGVPSRFSGSGSGKD YTLSITSLQTEDVATYYCQQYWSTPTFGGGTKLEIKGSTSGSG KPGSGEGSKVQLQESGPSLVQPSQRLSITCTVSGFSLISYGVH WVRQSPGKGLEWLGVIWRGGSTDYNAAFMSRLSITKDNSKS QVFFKMNSLQADDTAIYFCAKTLITTGYAMDYWGQGTTVTV SS |
| SEQ ID NO: 462 | exemplary cell-targeting molecule 175 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIQMTQSPSSLSASVGDRVTITCRAS QDVNTAVAWYQQKPGKAPKLLIYSASFLYSGVPSRFSGSRSG TDFTLTISSLQPEDFATYYCQQHYTTPPTFGQGTKVEIKRTGST SGSGKPGSGEGSEVQLVESGGGLVQPGGSLRLSCAASGFNIKD TYIHWVRQAPGKGLEWVARIYPTNGYTRYADSVKGRFTISAD TSKNTAYLQMNSLRAEDTAVYYCSRWGGDGFYAMDVWGQ GTLVTVSS |
| SEQ ID NO: 463 | exemplary cell-targeting molecule 176 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYNMTAEDVDLTLNWGRLSSVLPDYH GQDSVRVGRISFGSINAILGSVALILNSHHASAVAAEFPKPST PPGSSGGAPGILGFVFTLDIQMTQSPSSLSASVGDRVTITCRAS QDVNTAVAWYQQKPGKAPKLLIYSASFLYSGVPSRFSGSRSG TDFTLTISSLQPEDFATYYCQQHYTTPPTFGQGTKVEIKRTGST SGSGKPGSGEGSEVQLVESGGGLVQPGGSLRLSCAASGFNIKD TYIHWVRQAPGKGLEWVARIYPTNGYTRYADSVKGRFTISAD TSKNTAYLQMNSLRAEDTAVYYCSRWGGDGFYAMDVWGQ GTLVTVSS |
| SEQ ID NO: 464 | exemplary cell-targeting molecule 177 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIVMTQAAPSIPVTPGESVSISCRSSK SLLNSNGNTYLYWFLQRPGQSPQLLIYRMSNLASGVPDRFSGS GSGTAFTLRISRVEAEDVGVYYCMQHLEYPFTFGAGTKLELK GSTSGSGKPGSGEGSEVQLQQSGPELIKPGASVKMSCKASGYT FTSYVMHWVKQKPGQGLEWIGYINPYNDGTKYNEKFKGKAT LTSDKSSSTAYMELSSLTSEDSAVYYCARGTYYYGSRVFDYW GQGTTLTVSS |

Sequence Listing

| ID Number | Text Description | Biological Sequence |
|---|---|---|
| SEQ ID NO: 465 | exemplary cell-targeting molecule 178 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIVMTQAAPSIPVTPGESVSISCRSSK SLLNSNGNTYLYWFLQRPGQSPQLLIYRMSNLASGVPDRFSGS GSGTAFTLRISRVEAEDVGVYYCMQHLEYPFTFGAGTKLELK GSTSGSGKPGSGEGSEVQLQQSGPELIKPGASVKMSCKASGYT FTSYVMHWVKQKPGQGLEWIGYINPYNDGTKYNEKFKGKAT LTSDKSSSTAYMELSSLTSEDSAVYYCARGTYYYGSRVFDYW GQGTTLTVSS |
| SEQ ID NO: 466 | exemplary cell-targeting molecule 179 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIQLTQSPLSLPVTLGQPASISCRSSQ SLVHRNGNTYLHWFQQRPGQSPRLLIYTVSNRFSGVPDRFSGS GSGTDFTLKISRVEAEDVGVYFCSQSSHVPPTFGAGTRLEIKGS TSGSGKPGSGEGSTKGQVQLQQSGSELKKPGASVKVSCKASG YTFTNYGVNEIKQAPGQGLQWMGWINPNTGEPTFDDDFKGR FAFSLDTSVSTAYLQISSLKADDTAVYFCSRSRGKNEAWFAY WGQGTLVTVSS |
| SEQ ID NO: 467 | exemplary cell-targeting molecule 180 | MKEFTILDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGATGILGFVFTLDIQLTQSPISLPVTLGQPASISCRSSQ SLVHRNGNTYLHWFQQRPGQSPRLLIYTVSNRFSGVPDRFSGS GSGTDFTLKISRVEAEDVGVYFCSQSSHVPPTFGAGTRLEIKGS TSGSGKPGSGEGSTKGQVQLQQSGSELKKPGASVKVSCKASG YTFTNYGVNWIKQAPGQGLQWMGWINPNTGEPTFDDDFKGR FAFSLDTSVSTAYLQISSLKADDTAVYFCSRSRGKNEAWFAY WGQGTLVTVSS |
| SEQ ID NO: 468 | exemplary cell-targeting molecule 181 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAAHHSED PSSKAPKAPGILGFVFTLEVQLVESGGGLVQAGGSLRLSCAAS GITFSINTMGWYRQAPKQRELVALISSIGDTYYADSVKGRFT ISRDNAKNTVYLQMNSLKPEDTAVYYCKRFRTAAQGTDYWG QGTQVTVSS |
| SEQ ID NO: 469 | exemplary cell-targeting molecule 182 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLEVQLVESGGGLVQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |
| SEQ ID NO: 470 | exemplary cell-targeting molecule 183 | MKEFTLDFSTAKTYVDSLNVIRSAIGTPLQTISSGGTSLLMIDS GIGDNLFAVDILGFDFTLGRFNNLRLIVERNNLYVTGFVNRTN NYFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAAHHSED PSSKAPKAPGILGFVFTLEVQLVESGGGLVQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |

Sequence Listing

| ID Number | Text Description | Biological Sequence |
|---|---|---|
| SEQ ID NO: 471 | exemplary cell-targeting molecule 184 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLEVQLVESGGGLVQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |
| SEQ ID NO: 472 | exemplary cell-targeting molecule 185 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIVLTQSPASLAVSLGQRATISCRAT ESVEYYGTSLVQWYQQKPGQPPKLLIYAASSVDSGVPARFSG SGSGTDFSLTIHPVEEDDIAMYFCQQSRRVPYTFGGGTKLEIK GGGGSEVQLQQSGPELVKPGASVKMSCKASGYTFTSYVMHW VKQKPGQGLEWIGYVNPFNDGTKYNEMFKGKATLTSDKSSS TAYMELSSLTSEDSAVYYCARQAWGYPWGQGTLVTVSA |
| SEQ ID NO: 473 | exemplary cell-targeting molecule 186 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIVLTQSPASLAVSLGQRATISCRAT ESVEYYGTSLVQWYQQKPGQPPKLLIYAASSVDSGVPARFSG SGSGTDFSLTIHPVEEDDIAMYFCQQSRRVPYTFGGGTKLEIK GGGGSEVQLQQSGPELVKPGASVKMSCKASGYTFTSYVMHW VKQKPGQGLEWIGYVNPFNDGTKYNEMFKGKATLTSDKSSS TAYMELSSLTSEDSAVYYCARQAWGYPWGQGTLVTVSA |
| SEQ ID NO: 474 | exemplary cell-targeting molecule 187 | VTEHDTLLYKEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVNTAEDVDLTLNWGRL SSVLPDYHGQDSVRVGRISFGSINAILGSVALILNSHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 475 | exemplary cell-targeting molecule 188 | GLDRNSGNYKEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKIIEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 476 | exemplary cell-targeting molecule 189 | GVMTRGRLKEFTLDFSTAKTYVDSLNVIRSAIGTPLQTISSGGT SLLMIDSGIGDNLFAVDILGFDFTLGRFNNLRLIVERNNLYVTG FVNRTNNVFYRFADFSHVTFPGTTAVTLSADSSYTTLQRVAGI SRTGMQINRHSLTTSYLALMSHSGTSLTQSVARAMLRFVTVT AEALRFRQIQRGFRTTLDDLSGASYVMTAEDVDLTLNWGRLS SVLPDYHGQDSVRVGRISFGSINAILGSVALILNSHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR |

| | | |
|---|---|---|
| | | Sequence Listing |
| ID Number | Text Description | Biological Sequence |
| | | GLEWIGVMWRGGSTDYNAAFMSRLNITKDNSKNQVSLRLSS<br>VTAADTAVYYCAKSMITTGFVMDSWGQGSLVTVSS |
| SEQ ID NO: 477 | exemplary cell-targeting molecule 190 | VYALPLKMLKEFTLDFSTAKTYVDSLNVIRSAIGTPLQTISSGG<br>TSLLMIDSGIGDNLFAVDILGFDFTLGRFNNLRLIVERNNLYVT<br>GFVNRTNNVFYRFADFSHVTFPGTTAVTLSADSSYTTLQRVA<br>GISRTGMQINRHSLTTSYLALMSHSGTSLTQSVARAMLRFVTV<br>TAEALRFRQIQRGFRTTLDDLSGASYVMTAEDVDLTLNWGRL<br>SSVLPDYHGQDSVRVGRISFGSINAILGSVALILNSHHASAVA<br>AEFPKPSTPPGSSGGAPDIQMTQSPSSLSASVGDRVTITCKASE<br>DIYNRLTWYQQKPGKAPKLLISGATSLETGVPSRFSGSGSGTD<br>FTFTISSLQPEDIATYYCQQYWSNPYTFGQGTKVEIKGGGGSQ<br>VQLQESGPGLVRPSQTLSLTCTVSGFSLTSYGVHWVRQPPGR<br>GLEWIGVMWRGGSTDYNAAFMSRLNITKDNSKNQVSLRLSS<br>VTAADTAVYYCAKSMITTGFVMDSWGQGSLVTVSS |
| SEQ ID NO: 478 | exemplary cell-targeting molecule 191 | NLVPMVATVKEFTLDFSTAKTYVDSLNVIRSAIGTPLQTISSGG<br>TSLLMIDSGIGDNLFAVDILGFDFTLGRFNNLRLIVERNNLYVT<br>GFVNRTNNVFYRFADFSHVTFPGTTAVTLSADSSYTTLQRVA<br>GISRTGMQINRHSLTTSYLALMSHSGTSLTQSVARAMLRFVTV<br>TAEALRFRQIQRGFRTTLDDLSGASYVMTAEDVDLTLNWGRL<br>SSVLPDYHGQDSVRVGRISFGSINAILGSVALILNSHHASAVA<br>AEFPKPSTPPGSSGGAPDIQMTQSPSSLSASVGDRVTITCKASE<br>DIYNRLTWYQQKPGKAPKLLISGATSLETGVPSRFSGSGSGTD<br>FTFTISSLQPEDIATYYCQQYWSNPYTFGQGTKVEIKGSTSGSG<br>KPGSGEGSTKGVQLQESGPGLIVRPSQTLSLTCTVSGFSLTSY<br>GVHWVRQPPGRGLEWIGVMWRGGSTDYNAAFMSRLNITKD<br>NSKNQVSLRLSSVTAADTAVYYCAKSMITTGFVMDSWGQGS<br>LVTVSS |
| SEQ ID NO: 479 | exemplary cell-targeting molecule 192 | GILGFVFTLAEFTLDFSTAKTYVDSLNVIRSAIGTPLQTISSGGT<br>SLLMIDSGIGDNLFAVDILGFDFTLGRFNNLRLIVERNNLYVTG<br>FCNRTNNVFYRFADFSHVTFPGTTAVTLSADSSYTTLQRVAGI<br>SRTGMQINRHSLTTSYLALMSHSATSLTQSVARAMLRFVTVT<br>AEALRFRQIQRGFRTTLDDLSGRSYVMTAEDVDLTLNWGRLS<br>SVLPDYHGQDSVRVGRISFGSINAILGSVALILNSHHASAVA<br>AEFPKPSTPPGSSGGAPDIQMTQSPSSLSASVGDRVTITCKASE<br>DIYNRLTWYQQKPGKAPKLLISGATSLETGVPSRFSGSGSGTD<br>FTFTISSLQPEDIATYYCQQYWSNPYTFGQGTKVEIKGSTSGSG<br>KPGSGEGSTKGVQLQESGPGLVRPSQTLSLTCTVSGFSLTSY<br>GVHWVRQPPGRGLEWIGVMWRGGSTDYNAAFMSRLNITKD<br>NSKNQVSLRLSSVTAADTAVYYCAKSMITTGFVMDSWGQGS<br>LVTVS |
| SEQ ID NO: 480 | exemplary cell-targeting molecule 193 | DIQMTQSPSSLSASVGDRVTITCRASQDVNTAVAWYQQKPGK<br>APKLLIYSASFLYSGVPSRFSGSRSGTDFTLTISSLQPEDFATYY<br>CQQHYTTPPTFGQGTKVEIKRTGSTSGSGKPGSGEGSEVQLVE<br>SGGGLVQPGGSLRLSCAASGFNIKDTYIHWVRQAPGKGLEWV<br>ARIYPTNGYTRYADSVKGRFTISADTSKNTAYLQMNSLRAED<br>TAVYYCSRWGGDGFYAMDVWGQGTLVTVSSEFPKPSTPPGS<br>SGGAPGILGFVFTLKEFTLDFSTAKTYVDSLNVIRSAIGTPLQTI<br>SSGGTSLLMIDSGIGDNLFAVDILGFDFTLGRFNNLRLIVERNN<br>LYVTGFVNRTNNVFYRFADFSHVTFPGTTAVTLSADSSYTTL<br>QRVAGISRTGMQINRHSLTTSYLALMSHSGTSLTQSVARAML<br>RFVTVTAEALRFRQIQRGFRTTLDDLSGASYVMTAEDVDLTL<br>NWGRLSSVLPDYHGQDSVRVGRISFGSINAILGSVALILNSHH<br>HASAVAA |
| SEQ ID NO: 481 | exemplary cell-targeting molecule 194 | QVQLQQPGAELVKPGASVKMSCKTSGYTFTSYNVHWVKQTP<br>GQGLEWIGAIYPGNGDTSFNQKFKGKATLTADKSSSTVYMQL<br>SSLTSEDSAVYYCARSNYYGSSYVWFTDVWGAGTTVTVSSGS<br>TSGSGKPGSGEGSQIVLSQSPTILSASPGEKVTMTCRASSSVSY<br>MDWYQQKPGSSPKPWIYATSNLASGVPARFSGSGSGTSYSLTI<br>SRVEAEDAATYYCQQWISNPPTFGAGTKLELKEFPKPSTPPGS<br>SGGAPGILGFVFTLKEFTLDFSTAKTYVDSLNVIRSAIGTPLQTI<br>SSGGTSLLMIDSGIGDNLFAVDILGEDFTLGRFNNLRLIVERNN<br>LYVTGFVNRTNNVFYRFADFSHVTFPGTTAVTLSADSSYTTL<br>QRVAGISRTGMQINRHSLTTSYLALMSHSGTSLTQSVARAML<br>RFVTVTAEALRFRQIQRGFRTTLDDLSGASYVMTAEDVDLTL<br>NWGRLSSVLPDYHGQDSVRVGRISFGSINAILGSVALILNSHH<br>HASAVAA |

| Sequence Listing | | |
|---|---|---|
| ID Number | Text Description | Biological Sequence |
| SEQ ID NO: 482 | exemplary cell-targeting molecule 195 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSVTEHDTLLY |
| SEQ ID NO: 483 | exemplary cell-targeting molecule 196 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSNLVPMVATV |
| SEQ ID NO: 484 | exemplary cell-targeting molecule 197 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSQYDPVAALF |
| SEQ ID NO: 485 | exemplary cell-targeting molecule 198 | KEFTLDFSTAKTYVDSLNVIRSAIGTPLQTISSGGTSLLMIDSGI GDNLFAVDILGFDFTLGRFNNLRLAVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKILISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VWCAKSMITTGFVMDSWGQGSLVTVSSCLGGLLTMV |
| SEQ ID NO: 486 | exemplary cell-targeting molecule 199 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDETLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSILRGSVAHK |
| SEQ ID NO: 487 | exemplary cell-targeting molecule 200 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLEIGVPSRFSGSGSGTDFTFTISSL QPEDIATYYCQQYWSNPYTFGQGTKVEIKGSTSGSGKPGSGE |

| ID Number | Text Description | Biological Sequence |
|---|---|---|
| | | GSTKGQVQLQESGPGLVRPSQTLSLTCTVSGFSLTSYGVHWV RQPPGRGLEWIGVMWRGGSTDYNAAFMSRLNITKDNSKNQV SLRLSSVTAADTAVYYCAKSMITTGFVMDSWGQGSLVTVSSN LVPMVATV |
| SEQ ID NO: 488 | exemplary cell-targeting molecule 201 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCRASQDVNTAVA WYQQKPGKAPKLLIYSASFLYSGVPSRFSGSRSGTDFTLTISSL QPEDFATYYCQQHYTTPPTFGQGTKVEIKGGGGSEVQLVESG GGLVQPGGSLRLSCAASGFNIKDTYIHWVRQAPGKGLEWVA RIYPTNGYTRYADSVKGRFTISADTSKNTAYLQMNSLRAEDT AVYYCSRWGGDGFYAMDYWGQGTLVTVSSNLVPMVATV |
| SEQ ID NO: 489 | exemplary cell-targeting molecule 202 | KEFTLDFSTAKTYVDSLNVIRSAIGTPLQTISSGGTSLLMIDSGI GDNLFAVIDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPEVQLVESGGGLVQPGGSLRLSCAASGFTFSDSWI HWVRQAPGKGLEWVAWISPYGGSTYYADSVKGRFTISADTS KNTAYLQMNSLRAEDTAVYYCARRHWPGGFDYWGQGTLVT VSSGGGGSGGGGSGGGGSGGGGSGGGGSDIQMTQSPSSLSAS VGDRVTITCRASQDVSTAVAWYQQKPGKAPKLLIYSASFLYS GVPSRFSGSGSGTDFTLTISSLQPEDFATYYCQQYLYHPATFG QGTKVEIKGILGFVFTL |
| SEQ ID NO: 490 | exemplary cell-targeting molecule 203 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGITAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCRASQGISSWLA WYQQKPEKAPKSLIYAASSLQSGVPSRFSGSGSGTDFTLTISSL QPEDFATYYCQQYNSYPYTFGQGTKLEIKGGGGSQVQLVQSG AEVKKPGASVKVSCKASGYTFTSYDVHWVRQAPGQRLEWM GWLHADTGITKFSQKFQGRVTITRDTSASTAYMELSSLRSEDT AVYYCARERIQLWFDYWGQGTLVTVSSNLVPMVATV |
| SEQ ID NO: 491 | exemplary cell-targeting molecule 204 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSNLVPMVATV |
| SEQ ID NO: 492 | exemplary cell-targeting molecule 205 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALTMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPQVQLQQPGAELVKPGASVKMSCKTSGYTFTSYN VHWVKQTPGQGLEWIGATYPGNGDTSFNQKFKGKATLTADK SSSTVYMQLSSLTSEDSAVYYCARSNYYGSSYVWFFDVWGA GTTVTVSSGSTSGSGKPGSGEGSQLIVLSQSPTILSASPGEKVTM TCRASSSVSYMDWYQQKPGSSPKPWIYATSNLASGVPARFSG SGSGTSYSLTISRVEAEDAATYYCQQWISNPPTFGAGTKLELK NLVPMVATV |

Sequence Listing

| ID Number | Text Description | Biological Sequence |
|---|---|---|
| SEQ ID NO: 493 | exemplary cell-targeting molecule 206 | KEFTLDFSTAKTYVDSLNVIRSAIGTPLQTISSGGTSLLMIDSGI GDNLFAVDILGFDFTLGRFNNLRLIVERNNLYVTGFVNRTNN VFYREADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFTKPST PPGSSGGAPQVQLVQSGAELVKPGASVKMSCKASGYTFTSYN MHWVKQTPGQGLEWIGAIYPGNGDTSYNQFKGKATLTADK SSSTAYMQLSSLTSEDSAVYYCARAQLRPNYWYFDVWGAGT TVTVSSGGGGSDIVLSQSPAILSASPGEKVTMTCRASSSVSYM HWYQQKPGSSPKPWIYATSNLASGVPARFSGSGSGTSYSLTIS RVEAEDAATYYCQQWISNPPTFGAGTKLELKNINPMVATV |
| SEQ ID NO: 494 | exemplary cell-targeting molecule 207 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPQVQLQQPGAELVKPGASVKMSCKASGYTFTSYN MHWVKQTPGRGLEWIGAIYPGNGDTSYNQFKGKATLTADK SSSTAYMQLSSLTSEDSAVYYCARSTYYGGDWYFNVWGAGT TVTVSAGSTSGSGKPGSGEGSTKGQIVLSQSPAILSASPGEKVT MTCRASSSVSYIHWFQQKPGSSPKPWIYATSNLASGVPVRFSG SGSGTSYSLTISRVEAEDAATYYCQQWTSNPPTFGGGTKLEIK NLVPMVATV |
| SEQ ID NO: 495 | exemplary cell-targeting molecule 208 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHFVTPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPEVQLVESGGGLVQAGGSLRLSCAASGITFSINTM GWYRQAPGKQRELVALISSIGDTYYADSVKGRFTISRDNAKN TVYLQMNSLKPEDTAVYYCKRFRTAAQGTDYWGQGTQVTV SSAHHSEDNLVPMVATV |
| SEQ ID NO: 496 | exemplary cell-targeting molecule 209 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPDIELTQSPSSFSVSLGDRVTITCKASEDIYNRLAW YQQKPGNAPRLLISGATSLETGVPSRFSGSGSGKDYTLSITSLQ TEDVATYYCQQYWSTPTFGGGTKLEIKGSTSGSGKPGSGEGS KVQLQESGPSLVQPSQRLSITCTVSGFSLISYGVHWVRQSPGK GLEWLGVIWRGGSTDYNAAFMSRLSITKDNSKSQVFFKMNSL QADDTAIYFCAKTLITTGYAMDYWGQGTTVTVSSNLVPMVA TV |
| SEQ ID NO: 497 | exemplary cell-targeting molecule 210 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAHHSED PSSKAPKAPEVQLVESGGGLVQAGGSLRLSCAASGITFSINTM GWYRQAPGKQRELVALISSIGDTYYADSVKGRFTISRDNAKN TVYLQMNSLKPEDTAVYYCKRFRTAAQGTDYWGQGTQVTV SSNLVPMVATV |
| SEQ ID NO: 498 | exemplary cell-targeting molecule 211 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNCHHHASAVAAEFPKPST PPGSSGGAPASVSDVPRDLEVVAATPTSLLISWCRQRCADSYR ITYGETGGNSPVQEFTVPGSWKTATISGLKPGVDYTITVYVVT HYYGWDRYSHPISINYRTGSNLVPMVATV |

Sequence Listing

| ID Number | Text Description | Biological Sequence |
|---|---|---|
| SEQ ID NO: 499 | exemplary cell-targeting molecule 212 | ASVSDVPRDLEVVAATPTSLLISWCRQRCADSYRITYGETGGN SPVQEFTVPGSWKTATISGLKPGVDYTITVYVVTHYYGWDRY SHPISINYRTGSEFPKPSTPPGSSGGAPKEFTLDFSTAKTYVDSL NVIRSAIGTPLQTISSGGTSLLMIDSGIGDNLFAVDILGFDFTLG RFNNLRLIVERNNLYVTGFVNRTNNVFYRFADFSHVTFPGTT AVTLSADSSYTTLQRVAGISRTGMQINRHSLTTSYLALMSHSG TSLTQSVARAMLRFVTVTADALRFRQIQRGFRTTLDDLSGAS YVMTAEDVDLTLNWGRLSSVLPDYHGQDSVRVGRISFGSINA ILGSVALILNSHHLHASAVAAANLVPMVATV |
| SEQ ID NO: 500 | exemplary cell-targeting molecule 213 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPDIVLTQSPASLAVSLGQRATISCRATESVEYYGTS LVQWYQQKPGQPPKLLIYAASSVDSGVPARFSGSGSGTDFSLT IHPVEEDDIAMYFCQQSRRVPYTFGGGTKLEIKGGGGSEVQLQ QSGPELVKPGASVKMSCKASGYTFTSYVMHWVKQKPGQGLE WIGYVNPFNDGTKYNEMFKGKATLTSDKSSSTAYMELSSLTS EDSAVYYCARQAWGYPWGQGTLVTVSANLVPMVATV |
| SEQ ID NO: 501 | exemplary cell-targeting molecule 214 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AGGGGSGGDIQMTQSPSSLSASVGDRVTITCKASEDIYNRLTW YQQKPGKAPKLLISGATSLETGVPSRFSGSGSGTDFTFTISSLQ PEDIATYYCQQYWSNPYTFGQGTKVEIKGGGGSQVQLQESGP GLVRPSQTLSLTCTVSGFSLTSYGVHWVRQPPGRGLEWIGVM WRGGSTDYNAAFMSRLNITKDNSKNQVSLRLSSVTAADTAV YYCAKSMITTGFVMDSWGQGSLVTVSS |
| SEQ ID NO: 502 | exemplary cell-targeting molecule 215 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGSTSGSG KPGSGEGSTKGQVQLQESGPGLVRPSQTLSLTCTVSGFSLTSY GVHWVRQPPGRGLEWIGVMWRGGSTDYNAAFMSRLNITKD NSKNQVSLRLSSVTAADTAVYYCAKSMITTGFVMDSWGQGS LVTVSS |
| SEQ ID NO: 503 | exemplary cell-targeting molecule 216 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNVFYRFADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AEFPKPSTPPGSSGGAPDIQMTQSPSSLSASVGDRVTITCRASQ DVNTAVAWYQQKPGKAPKLLIYSASFLYSGVPSRFSGSRSGT DFTLTISSLQPEDFATYYCQQHYTTPPTFGQGTKVEIKGGGGS EVQLVESGGGLVQPGGSLRLSCAASGFNIKDTYIHWVRQAPG KGLEWVARIYPTNGYTRYADSVKGRFTISADTSKNTAYLQM NSLRAEDTAVYYCSRWGGDGFYAMDYWGQGTLVTVSS |
| SEQ ID NO: 504 | exemplary cell-targeting molecule 217 | GILGFVFTLKEFTLDFSTAKTYVDSLNVIRSAIGTPLQTISSGGT SLLMIDSGIGDNLFAVDILGFDFTLGRFNNLRLIVERNNLYVTG FVNRTNNVFYRFADFSHVTFPGTTAVTLSADSSYTTLQRVAGI SRTGMQINRHSLTTSYLALMSHSGTSLTQSVARAMLRFVTVT AEALRFRQIQRGFRTTLDDLSGASYVMTAEDVDLTLNWGRLS SVLPDYHGQDSVRVGRISFGSINAILGSVALILNSHHHASAVA AEFPKPSTPPGSSGGAPEVQLVESGGGLVQPGGSLRLSCAASG FTFSDSWIHWVRQAPGKGLEWVAWISPYGGSTYYADSVKGR FTISADTSKNTAYLQMNSLRAEDTAVYYCARRHWPGGFDYW GQGTLVTVSSGGGGSGGGGSGGGGSGGGGSGGGGSDIQMTQ SPSSLSASVGDRVTITCRASQDVSTAVAWYQQKPGKAPKLLIY |

Sequence Listing

| ID Number | Text Description | Biological Sequence |
|---|---|---|
| | | SASFLYSGVPSRESGSGSGTDFTLTISSLQPEDFATYYCQQYLY<br>HPATFGQGTKVEIK |
| SEQ ID NO: 505 | exemplary cell-targeting molecule 218 | NLVPMVATVKEFTLDFSTAKTYVDSLNVIRSAIGTPLQTISSGG<br>TSLLMIDSGIGDNLFAVDILGFDFTLGRFNNLRLIVERNNLYVT<br>GFVNRTNNVFYRFADFSHVTFPGTTAVTLSADSSYTTLQRVA<br>GISRTGMQINRHSLTTSYLALMSHSGTSLTQSVARAMLRFVTV<br>TAEALRFRQIQRGFRTTLDDLSGASYVMTAEDVDLTLNWGRL<br>SSVLPDYHGQDSVRVGRISFGSINAILGSVALILNSHHHASAVA<br>AGGGGSGGDIQMTQSPSSLSASVGDRVTITCRASQGISSWLA<br>WYQQKPEKAPKSLIYAASSLQSGVPSRFSGSGSGTDFTLTISSL<br>QPEDFATYYCQQYNSYPYTFGQGTKLEIKGGGGSQVQLVQSG<br>AEVKKPGASVKVSCKASGYTFTSYDVHWVRQAPGQRLEWM<br>GWLHADTGITKFSQKFQGRVTITRDTSASTAYMELSSLRSEDT<br>AVYYCARERIQLWFDYWGQGTLVTVSS |
| SEQ ID NO: 506 | exemplary cell-targeting molecule 219 | NLVPMVATVKEFTLDFSTAKTYVDSLNVIRSAIGTPLQTISSGG<br>TSLLMIDSGIGDNLFAVDILGFDFTLGRFNNLRLIVERNNLYVT<br>GFVNRTNNVFYRFADFSHVTFPGTTAVTLSADSSYITLQRVA<br>GISRTGMQINRHSLTTSYLALMSHSGTSLTQSVARAMLRFVTV<br>TAEALRFRQIQRGFRTTLDDLSGASYVMTAEDVDLTLNWGRL<br>SSVLPDYHGQDSVRVGRISFGSINAILGSVALILNSHHHASAVA<br>AEFPKPSTPPGSSGGAPDIQMTQSPSSLSASVGDRVTITCKASE<br>DIYNRLTWYQQKPGKAPKLLISGATSLETGVPSRFSGSGSGTD<br>FTFTISSLQPEDIATYYCQQYWSNPYTFGQGTKVEIKGGGGSQ<br>VQLQESGPGLVRPSQTLSLTCTVSGFSLTSYGVHWVRQPPGR<br>GLEWIGVMWRGGSTDYNAAFMSRLNITKDNSKNQVSLRLSS<br>VTAADTAVYYCAKSMITTGFVMDSWGQGSLVTVSS |
| SEQ ID NO: 507 | exemplary cell-targeting molecule 220 | NLVPMVATVKEFTLDFSTAKTYVDSLNVIRSAIGTPLQTISSGG<br>TSLLMIDSGIGDNLFAVDILGFDFTLGRFNNLRLIVERNNLYVT<br>GFVNRTNNVFYRFADFSHVTFPGTTAVTLSADSSYTTLQRVA<br>GISRTGMQINRHSLTTSYLALMSHSGTSLTQSVARAMLRFVTV<br>TAEALRFRQIQRGFRTTLDDLSGASYVMTAEDVDLTLNWGRL<br>SSVLPDYHGQDSVRVGRISFGSINAILGSVALILNSHHHASAVA<br>AEFPKPSTPPGSSGGAPQVQLQQPGAELVKPGASVKMSCKTS<br>GYTFTSYNVHWVKQTPGQGLEWIGAIYPGNGDTSFNQKFKG<br>KATLTADKSSSTVYMQLSSLTSEDSAVYYCARSNYYGSSYV<br>WFFDVWGAGTTVTVSSGSTSGSGKPGSGEGSQIVLSQSPTILS<br>ASPGEKVTMTCRASSSVSYMDWYQQKPGSSPKPWIYATSNL<br>ASGVPARFSGSGSGTSYSLTISRVEAEDAATYYCQQWISNPPT<br>FGAGTKLELK |
| SEQ ID NO: 508 | exemplary cell-targeting molecule 221 | NLVPMVATVKEFTLDFSTAKTYVDSLNVIRSAIGTPLQTISSGG<br>TSLLMIDSGIGDNLFAVDILGFDFTLGRFNNLRLIVERNNLYVT<br>GFVNRTNNVFYRFADFSHVTFPGTTAVTLSADSSYTTLQRVA<br>GISRTGMQINRHSLTTSYLALMSHSGTSLTQSVARAMLRFVTV<br>TAEALRFRQIQRGFRTTLDDLSGASYVMTAEDVDLTLNWGRL<br>SSVLPDYHGQDSVRVGRISFGSINALLGSVALILNSHHHASAVA<br>AGGGGSGGQVQLVQSGAELVKPGASVKMSCKASGYTFTSYN<br>MHWVKQTPGQGLEWIGAIYPGNGDTSYNQKFKGKATLTADK<br>SSSTAYMQLSSLTSEDSAVYYCARAQLRPNYWYFDVWGAGT<br>TVTVSSGGGGSGGGGSGGGGSGGGGSGGGGSDIVLSQSPAILS<br>ASPGEKVTMTCRASSSVSYMHWYQQKPGSSPKPWIYATSNL<br>ASGVPARFSGSGSGTSYSLTISRVEAEDAATYYCQQWISNPPT<br>FGAGTKLELK |
| SEQ ID NO: 509 | exemplary cell-targeting molecule 222 | APTSSSTKKTQLQLEHLLLDLQMILNGINNYKNPKLTRMLTFK<br>FYMPKKATELKHLQCLEEELKPLEEVLNLAQSKNFHLRPRDLI<br>SNINVIVLELKGSETTFMCEYADETATIVEFLNRWITFCQSIIST<br>LTEFPKPSTPPGSSGGAPNLVPMVATVKEFTLDFSTAKTYVDS<br>LNVIRSAIGTPLQTISSGGTSLLMIDSGIGDNLFAVDILGFDFTL<br>GRFNNLRLIVERNNLYVTGFVNRTNNVFYRFADFSHVTFPGT<br>TAVTLSADSSYTTLQRVAGISRTGMQINRHSLTTSYLALMSHS<br>GTSLTQSVARAMLRFVTVTAEALRFRQIQRGFRTTLDDLSGAS<br>YVMTAEDVDLTLNWGRLSSVLPDYHGQDSVRVGRISFGSINA<br>ILGSVALILNSHHHASAVAA |
| SEQ ID NO: 510 | exemplary cell-targeting molecule 223 | GILGFVFTLKEFTLDFSTAKTYVDSLNVIRSAIGTPLQTISSGGT<br>SLLMIDSGIGDNLFAVDILGFDFTLGRFNNLRLIVERNNLYVTG<br>FVNRTNNVFYRFADFSHVTFPGTTAVTLSADSSYTTLQRVAGI<br>SRTGMQINRHSLTTSYLALMSHSGTSLTQSVARAMLRFVTVT<br>AEALRFRQIQRGFRTTLDDLSGASYVMTAEDVDLTLNWGRLS<br>SVLPDYHGQDSVRVGRISFGSINAILGSVALILNSHHHASAVA |

-continued

Sequence Listing

| ID Number | Text Description | Biological Sequence |
|---|---|---|
| | | AEFPKPSTPPGSSGGAPAPTSSSTKKTQLQLEHLLLDLQMILNG<br>INNYKNPKLTRMLTFKFYMPKKATELKHLQCLEEELKPLEEV<br>LNLAQSKNFHLRPRDLISNINVIVLELKGSETTFMCEYADETA<br>TIVEFLNRWITFCQSIISTLT |
| SEQ ID NO: 511 | exemplary cell-targeting molecule 224 | MNLVPMVATYKEFTLDFSTAKTYVDSLNVIRSAIGTPLQTISS<br>GGTSLLMIDSGIGDNLFAVDILGFDFTLGRFNNLRLIVERNNLY<br>VTGFVNRTNNVFYRFADFSHVTFPGTTAVTLSADSSYTTLQR<br>VAGISRTGMQINRHSLTTSYLALMSHSGTSLTQSVARAMLRF<br>VTVTAEALRFRQIQRGFRTTLDDLSGASYVMTAEDVDLTLNW<br>GRLSSVLPDYGGQDSVRVGRISFGSINAILGSVALILNSHHHAS<br>AVAAEFPKPSTPPGSSGGAPDIQMTQSPSSTSASVGDRVTITCK<br>ASEDIYNRLTWYQQKPGKAPKLLISGATSLETGVPSRFSGSGS<br>GTDFTFTISSLQPEDIATYYCQQYWSNPYTFGQGTKVEIKGSTS<br>GSGKPGSGEGSTKGVQLQESGPGLVRPSQTLSLTCTVSGFSL<br>TSYGVHWVRQPPGRGLEWIGVMWRGGSTDYNAAFMSRLNIT<br>KDNSKNQVSLRLSSVTAADTAVYYCAKSMITTGFVMDSWGQ<br>GSLVTVSS |
| SEQ ID NO: 512 | exemplary cell-targeting molecule 225 | MNLVPMVATVKEFTLDFSTAKTYVDSLNVIRSAIGTPLQTISS<br>GGTSLLMIDSGIGDNLFAVDILGFDFTLGRFNNLRLIVERNNLY<br>VTGFVNRTNNVFYRFADFSHVTFPGTTAVTLSADSSYTTLQR<br>VAGISRTGMQINRHSLTTSYLALMSHSGTSLTQSVARAMLRF<br>VTVTAEALRFRQIQRGFRTTLDDLSGASYVMTAEDVDLTLNW<br>GRLSSVLPDYHGQDSVRVGRISFGSINAILGSVALILNSHHHAS<br>AVAAEFPKPSTPPGSSGGAPDIQMTQSPSSLSASVGDRVTITCK<br>ASEDIYNRLTWYQQKPGKAPKLLISGATSLETGVPSRFSGSGS<br>GTDFTFTISSLQPEDIATYYCQQYWSNPYTFGQGTKVEIKGSTS<br>GSGKPGSGEGSTKGVQLQESGPGLVRPSQTLSLTCTVSGFSL<br>TSYGVHWVRQPPGRGLEWIGVMWRGGSTDYNAAFMSRLNIT<br>KDNSKNQVSLRLSSVTAADTAVYYCAKSMITTGFVMDSWGQ<br>GSLVTVSS |
| SEQ ID NO: 513 | exemplary cell-targeting molecule 226 | MKEFTLDFSTAKTYVDSLNVIRSAIGTPLQTISSGGTSLLMIDS<br>GIGDNLFAVDILGFDFTLGRFNNLRLIVERNNLYVTGFVNRTN<br>NVFYRFADFSHVTFPGTTAVTLSADSSYTTLQRVAGISRTGMQ<br>INRHSLTTSYLALMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHHASAVAAEFPKPST<br>PPGSSGGAPDIQMTQSPSSLSASVGDRVTITCKASEDIYNRLT<br>WYQQKPGKAPKLLISGATSLETGVPSRFSGSGSGTDFTFTISSL<br>QPEDIATYYCQQYWSNPYTFGQGTKVEIKGSTSGSGKPGSGE<br>GSTKGVQLQESGPGLVRPSQTLSLTCTVSGFSLTSYGVHWV<br>RQPPGRGLEWIGVMWRGGSTDYNAAFMSRLNITKDNSKNQV<br>SLRLSSVTAADTAVYYCAKSMITTGFVMDSWGQGSLVTVSSN<br>LVPMVATV |
| SEQ ID NO: 514 | exemplary cell-targeting molecule 227 | MKEFTLDFSTAKTYVDSLNVIRSAIGTPLQTISSGGTSLLMIDS<br>GIGDNLFAVDILGFDFTLGRFNNLRLIVERNNLYVTGFVNRTN<br>NVFYRFADFSHVTFPGTTAVTLSADSSYTTLQRVAGISRTGMQ<br>INRHSLTTSYLALMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHHASAVAAEFPKPST<br>PPGSSGGAPDIQMTQSPSSLSASVGDRVTITCKASEDIYNRLT<br>WYQQKPGKAPKLLISGATSLETGVPSRFSGSGSGTDFTFTISSL<br>QPEDIATYYCQQYWSNPYTFGQGTKVEIKGSTSGSGKPGSGE<br>GSTKGVQLQESGPGLVRPSQTLSLTCTVSGFSLTSYGVHWV<br>RQPPGRGLEWIGVMWRGGSTDYNAAFMSRLNITKDNSKNQV<br>SLRLSSVTAADTAVYYCAKSMITTGFVMDSWGQGSLVTVSSN<br>LVPMVATV |
| SEQ ID NO: 515 | exemplary cell-targeting molecule 228 | MGILGFVFTLKEFTLDFSTAKTYVDSLNVIRSAIGTPLQTISSG<br>GTSLLMIDSGIGDNLFAVDILGFDFTLGRFNNLRLIVERNNLYV<br>TGFVNRTNNVFYRFADFSHVTFPGTTAVTLSADSSYTTLQRV<br>AGISRTGMQINRHSLTTSYLALMSHSGTSLTQSVARAMLRFVT<br>VTAEALRFRQIQRGFRTTLDDLSGASYVMTAEDVDLTLNWG<br>RLSSVLPDYHGQDSVRVGRISFGSINAILGSVALILNSHHHASA<br>VAAEFPKPSTPPGSSGGAPDIQMTQSPSSLSASVGDRVTITCKA<br>SEDIYNRLTWYQQKPGKAPKLLISGATSLETGVPSRFSGSGS<br>TDFTFTISSLQPEDIATYYCQQYWSNPYTFGQGTKVEIKGSTSG<br>SGKPGSGEGSTKGVQLQESGPGLVRPSQTLSLTCTVSGFSLT<br>SYGVHWVRQPPGRGLEWIGVMWRGGSTDYNAAFMSRLNIT<br>KDNSKNQVSLRLSSVTAADTAVYYCAKSMITTGFVMDSWGQ<br>GSLVTVSS |

| | | |
|---|---|---|
| Sequence Listing | | |
| ID Number | Text Description | Biological Sequence |
| SEQ ID NO: 516 | exemplary cell-targeting molecule 229 | MDIQMTQSPSSLSASVGDRVTITCRASQDVNTAVAWYQQKP GKAPKLLIYSASFLYSGVPSRFSGSRSGTDFTLTISSLQPEDFAT YYCQQHYTTPPTFGQGTKVEIKRTGSTSGSGKPGSGEGSEVQL VESGGGLVQPGGSLRLSCAASGFNIKDTYIHWVRQAPGKGLE WVARIYPTNGYTRYADSVKGRFTISADTSKNTAYLQMNSLRA EDTAVYYCSRWGGDGFYAMDVWGQGTLVTVSSEFPKPSTPP GSSSGGAPGILGFVFTIKEFTLDFSTAKTYVDSLNVIRSAIGTPL QTISSGGTSLLMIDSGIGDNLFAVDILGFDFTLGRFNNLRLIVER NNLYVTGFVNRTNNVFYRFADFSHVTFPGTTAVTLSADSSYT TLQRVAGISRTGMQINRHSLTTSYLALMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAA |
| SEQ ID NO: 517 | exemplary cell-targeting molecule 230 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLALMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAA |
| SEQ ID NO: 518 | exemplary cell-targeting molecule 231 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPDIQMTQSPSSLSASVGDRVTITCRASQDVNTAVA WYQQKPGKAPKLLIYSASFLYSGVPSRFSGSRSGTDFTLTISSL QPEDFATYYCQQHYTTPPTFGQGTKVEIKGGGGSEVQLVESG GGLVQPGGSLRLSCAASGFNIKDTYIHWVRQAPGKGLEWVA RIYPTNGYTRYADSVKGRFTISADTSKNTAYLQMNSLRAEDT AVYYCSRWGGDGFYAMDYWGQGTLVTVSSNLVPMVATV |
| SEQ ID NO: 519 | exemplary cell-targeting molecule 232 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPEVQLVESGGGLVQPGGSLRLSCAASGFTFSDSWI HWVRQAPGKGLEWVAWISPYGGSTYYADSVKGRFTISADTS KNTAYLQMNSLRAEDTAVYYCARRHWPGGFDYWGQGTLVT VSSGGGGSGGGGSGGGGSGGGGSGGGGSDIQMTQSPSSLSAS VGDRVTITCRASQDVSTAVAWYQQKPGKAPKLLIYSASFLYS GVPSRFSGSGSGMFTLTISSLQPEDFATYYCQQYLYHPATFG QGTKVEIKGILGFVFTL |
| SEQ ID NO: 520 | exemplary cell-targeting molecule 233 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPEVQLVESGGGLVQPGGSLRLSCAASGFTFSDSWI HWVRQAPGKGLEWVAWISPYGGSTYYADSVKGRFTISADTS KNTAYLQMNSLRAEDTAVYYCARRHWPGGFDYWGQGTLVT VSSGGGGSGGGGSGGGGSGGGGSGGGGSDIQMTQSPSSLSAS VGDRVTITCRASQDVSTAVAWYQQKPGKAPKLLIYSASFLYS GVPSRFSGSGSGTDFTLTISSLQPEDFATYYCQQYLYHPATFG QGTKVEIKGILGFVFTL |
| SEQ ID NO: 521 | exemplary cell-targeting molecule 234 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR |

| ID Number | Text Description | Biological Sequence |
|---|---|---|
| | | QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCRASQGISSWLA WYQQKPEKAPKSLIYAASSLQSGVPSRFSGSGSGTDFTLTISSL QPEDFATYYCQQYNSYPYTFGQGTKLEIKGGGGSQVQLVQSG AEVKKPGASVKVSCKASGYTFTSYDVHWVRQAPGQRLEWM GWLHADTGITKFSQKFQGRVTITRDTSASTAYMELSSLRSEDT AVYYCARERIQLWFDYWGQGTLVTVSSNLVPMVATV |
| SEQ ID NO: 522 | exemplary cell-targeting molecule 235 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSNLVPMVATV |
| SEQ ID NO: 523 | exemplary cell-targeting molecule 236 | QVQLQQPGAELVKPGASVKMSCKTSGYTFTSYNVHWVKQTP GQGLEWIGAIYPGNGDTSFNQKFKGKATLTADKSSSTVYMQL SSLTSEDSAVYYCARSNYYGSSYVWFFDVWGAGTTVTVSSGS TSGSGKPGSGEGSQIVLSQSPTILSASPGEKVTMTCRASSSVSY MDWYQQKPGSSPKPWIYATSNLASGVPARFSGSGSGTSYSLTI SRVEAEDAATYYCQQWISNPPTFGAGTKLELKEFPKPSTPPGS SGGAPGILGFVFTLKEFTLDFSTAKTYVDSLNVIRSAIGTPLQTI SSGGTSLLMIDSGIGDNLFAVDILGFDFTLGRFNNLRLIVERNN LYVTGFVNRTNNVFYRFADFSHVTFPGTTAVTLSADSSYTTL QRVAGISRTGMQINRHSLTTSYLALMSHSGTSLTQSVARAML RFVTVTAEALRFRQIQRGFRTTLDDLSGASYVMTAEDVDLTL NWGRLSSVLPDYHGQDSVRVGRISFGSINAILGSVALILNSHH HASAVAA |
| SEQ ID NO: 524 | exemplary cell-targeting molecule 237 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLALMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAA |
| SEQ ID NO: 525 | exemplary cell-targeting molecule 238 | MDIQMTQSPSSLSASVGDRVTITCRASQDVNTAVAWYQQKP GKAPKLLIYSASFLYSGVPSRESGSRSGTDFTLTISSLQPEDFAT YYCQQHYTTPPTFGQGTKVEIKRTGSTSGSGKPGSGEGSEVQL VESGGGLVQPGGSLRLSCAASGFNIKDTYIHWVRQAPGKGLE WVARIYPTNGYTRYADSVKGRFTISADTSKNTAYLQMNSLRA EDTAVYYCSRWGGDGFYAMDVWGQGTLVTVSSEFPKPSTPP GSSGGAPGILGFVFTLKEFTLDFSTAKTYVDSLNVIRSAIGTPL QTISSGGTSLLMIDSGIGDNLFAVDILGFDFTLGRFNNLRLIVER NNLYVTGFVNRTNNVFYRFADFSHVTFPGTTAVTLSADSSYT TLQRVAGISRTGMQINRHSLTTSYLALMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAAKDEL |
| SEQ ID NO: 526 | exemplary cell-targeting molecule 239 | MDIQMTQSPSSLSASVGDRVTITCRASQDVNTAVAWYQQKP GKAPKLLIYSASFLYSGVPSRFSGSRSGTDFTLTISSLQPEDFAT YYCQQHYTTPPTFGQGTKVEIKRTGSTSGSGKPGSGEGSEVQL VESGGGLVQPGGSLRLSCAASGFNIKDTYIHWVRQAPGKGLE WVARIYPTNGYTRYADSVKGRFTISADTSKNTAYLQMNSLRA EDTAVYYCSRWGGDGFYAMDVWGQGTLVTVSSEFPKPSTPP GSSGGAPGILGFVFTLKEFTLDFSTAKTYVDSLNVIRSAIGTPL QTISSGGTSLLMIDSGIGDNLFAVDILGFDFTLGRFNNLRLIVER NNLYVTGFVNRTNNVFYRFADFSHVTFPGTTAVTLSADSSYT TLQRVAGISRTGMQINRHSLTTSYLALMSHSGTSLTQSVARA |

| ID Number | Text Description | Biological Sequence |
|---|---|---|
| | | MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAAKDEL |
| SEQ ID NO: 527 | exemplary cell-targeting molecule 240 | MDIELTQSPSSFSVSLGDRVTITCKASEDIYNRLAWYQQKPGN<br>APRLLISGATSLETGVPSRFSGSGSGKDYTLSITSLQTEDVATY<br>YCQQYWSTPTFGGGTKLEIKGSTSGSGKPGSGEGSKVQLQES<br>GPSLVQPSQRLSITCTVSGFSLISYGVHWVRQSPGKGLEWLGV<br>IWRGGSTDYNAAFMSRLSITKDNSKSQVFFKMNSLQADDTAI<br>YFCAKTLITTGYAMDYWGQGTTVTVSSEFPKPSTPPGSSGGAP<br>GILGFVFTLKEFTLDFSTAKTYVDSLNVIRSAIGTPLQTISSGGT<br>SLLMIDSGIGDNLFAVDILGFDFTLGRFNNLRLIVERNNLYVTG<br>FVNRTNNVFYRFADFSHVTFPGTTAVTLSADSSYTTLQRVAGI<br>SRTGMQINRHSLTTSYLALMSHSGTSLTQSVARAMLRFVTVT<br>AEALRFRQIQRGFRTTLDDLSGASYVMTAEDVDLTLNWGRLS<br>SVLPDYHGQDSVRVGRISFGSINAILGSVALILNSHHHASAVA<br>AKDEL |
| SEQ ID NO: 528 | exemplary cell-targeting molecule 241 | MDIELTQSPSSFSVSLGDRVTITCKASEDIYNRLAWYQQKPGN<br>APRLLISGATSLETGVPSRFSGSGSGKDYTLSITSLQTEDVATY<br>YCQQYWSTPTFGGGTKLEIKGSTSGSGKPGSGEGSKVQLQES<br>GPSLVQPSQRLSITCTVSGFSLISYGVHWVRQSPGKGLEWLGV<br>IWRGGSTDYNAAFMSRLSITKDNSKSQVFFKMNSLQADDTAI<br>YFCAKTLITTGYAMDYWGQGTTVTVSSEFPKPSTPPGSSGGAP<br>GILGFVFTLKEFTLDFSTAKTYVDSLNVIRSAIGTPLQTISSGGT<br>SLLMIDSGIGDNLFAVDILGFDFTLGRFNNLRLIVERNNLYVTG<br>FVNRTNNVFYRFADFSHVTFPGITAVTLSADSSYTTLQRVAGI<br>SRTGMQINRHSLTTSYLALMSHSGTSLTQSVARAMLRFVTVT<br>AEALRFRQIQRGFRTTLDDLSGASYVMTAEDVDLTLNWGRLS<br>SVLPDYHGQDSVRVGRISFGSINAILGSVALILNSHHHASAVA<br>AKDEL |
| SEQ ID NO: 529 | exemplary cell-targeting molecule 242 | MDIVMTQAAPSIPVTPGESVSISCRSSKSLLNSNGNTYLYWFL<br>QRPGQSPQLLIYRMSNLASGVPDRFSGSGSGTAFTLRISRVEAE<br>DVGVYYCMQHLEYPFTFGAGTKLELKGSTSGSGKPGSGEGSE<br>VQLQQSGPELIKPGASVKMSCKASGYTFTSYVMHWVKQKPG<br>QGLEWIGYINPYNDGTKYNEKFKGKATLTSDKSSSTAYMELS<br>SLTSEDSAVYYCARGTYYYGSRVFDYWGQGTTLTVSSAEFPK<br>PSTPPGSSGGAPGILGFVFTLKEFTLDFSTAKTYVDSLNVIRSAI<br>GTPLQTISSGGTSLLMIDSGIGDNLFAVDILGFDFTLGRFNNLR<br>LIVERNNLYVTGFVNRTNNVFYRFADFSHVTFPGTTAVTLSA<br>DSSYTTLQRVAGISRTGMQINRHSLTTSYLALMSHSGTSLTQS<br>VARAMLRFVTVTAEALRFRQIQRGFRTTLDDLSGASYVMTAE<br>DVDLTLNWGRLSSVLPDYHGQDSVRVGRISFGSINAILGSVAL<br>ILNSHHHASAVAAKDEL |
| SEQ ID NO: 530 | exemplary cell-targeting molecule 243 | MDIVMTQAAPSIPVTPGESVSISCRSSKSLLNSNGNTYLYWFL<br>QRPGQSPQLLIYRMSNLASGVPDRFSGSGSGTAFTLRISRVEAE<br>DVGVYYCMQHLEYPFTFGAGTKLELKGSTSGSGKPGSGEGSE<br>VQLQQSGPELIKPGASVKMSCKASGYTFTSYVMHWVKQKPG<br>QGLEWIGYINPYNDGTKYNEKFKGKATLTSDKSSSTAYMELS<br>SLTSEDSAVYYCARGTYYYGSRVFDYWGQGTTLTVSSAEFPK<br>PSTPPGSSGGAPGILGFVFTLKEFTLDFSTAKIYVDSLNVIRSAI<br>GTPLQTISSGGTSLLMIDSGIGDNLFAVDILGFDFTLGRFNNLR<br>LIVERNNLYVTGFVNRTNNVFYRFADFSHVTFPGTTAVTLSA<br>DSSYTTLQRVAGISRTGMQINRHSLTTSYLALMSHSGTSLTQS<br>VARAMLRFVTVTAEALRFRQIQRGFRTTLDDLSGASYVMTAE<br>DVDLTLNWGRLSSVLPDYHGQDSVRVGRISFGSINAILGSVAL<br>ILNSHHHASAVAAKDEL |
| SEQ ID NO: 531 | exemplary cell-targeting molecule 244 | MDIQLTQSPLSLPVTLGQPASISCRSSQSLVHRNGNTYLHWFQ<br>QRPGQSPRLLIYTVSNRFSGVPDRFSGSGSGTDFTLKISRVEAE<br>DVGVYFCSQSSHVPPTFGAGTRLEIKGSTSGSGKPGSGEGSTK<br>GQVQLQQSGSELKKPGASVKVSCKASGYTFTNYGVNWIKQA<br>PGQGLQWMGWINPNTGEPTFDDDFKGRFAFSLDTSVSTAYLQ<br>ISSLKADDTAVYFCSRSRGKNEAWFAYWGQGTLVTVSSEFPK<br>PSTPPGSSGGAPGILGFVFTLKEFTLDFSTAKTYVDSLNVIRSAI<br>GTPLQTISSGGTSLLMIDSGIGDNLFAVDILGFDFTLGRFNNLR<br>LIVERNNLYVTGFVNRTNNVFYRFADFSHVTFPGTTAVTLSA<br>DSSYTTLQRVAGISRTGMQINRHSLTTSYLALMSHSGTSLTQS<br>VARAMLRFVTVTAEALRFRQIQRGFRTTLDDLSGASYVMTAE<br>DVDLTLNWGRLSSVLPDYHGQDSVRVGRISFGSINAILGSVAL<br>ILNSHHHASAVAAKDEL |

| Sequence Listing | | |
|---|---|---|
| ID Number | Text Description | Biological Sequence |
| SEQ ID NO: 532 | exemplary cell-targeting molecule 245 | MDIQLTQSPLSLPVTLGQPASISCRSSQSLVHRNGNTYLHWFQ QRPGQSPRLLIYTVSNRFSGVPDRFSGSGSGTDFTLKISRVEAE DVGVYFCSQSSHVPPTFGAGTRLEIKGSTSGSGKPGSGEGSTK GQVQLQQSGSELKKPGASVKVSCKASGYTFTNYGVNWIKQA PGQGLQWMGWINPNTGEPTFDDDFKGRFAFSLDTSVSTAYLQ ISSLKADDTAVYFCSRSRGKNEAWFAYWGQGTLVTVSSEFPK PSTPPGSSGGAPGILGFVFTLKEFTLDFSTAKTYVDSLNVIRSAI GTPLQTISSGGTSLLMIDSGIGDNLFAVDILGFDFTLGRFNNLR LIVERNNLYVTGFVNRTNNVFYRFADFSHVTFPGTTAVTLSA DSSYTTLQRVAGISRTGMQINRHSLTTSYLALMSHSGTSLTQS VARAMLRFVTVTAEALRFRQIQRGFRTTLDDLSGASYVMTAE DVDLTLNWGRLSSVLPDYHGQDSVRVGRISFGSINAILGSVAL ILNSHHHASAVAAKDEL |
| SEQ ID NO: 533 | exemplary cell-targeting molecule 246 | MEVQLVESGGGLVQAGGSLRLSCAASGITFSINTMGWYRQAP GKQRELVALISSIGDTYYADSVKGRFTISRDNAKNTWLQMN SLKPEDTAVYYCKRFRTAAQGTDYWGQGTQVTVSSAHHSED PSSKAPKAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLALMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAAKDEL |
| SEQ ID NO: 534 | exemplary cell-targeting molecule 247 | MEVQLVESGGGLVQAGGSLRLSCAASGITFSINTMGWYRQAP GKQRELVALISSIGDTYYADSVKGRFTISRDNAKNTVYLQMN SLKPEDTAVYYCKRFRTAAQGTDYWGQGTQVTVSSEFPKPST PPGSSGGAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNVFYRFADFSHVTFPGTTAVTLSADSSY TTLQRVAGISRTGMQINRHSLTTSYLALMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAAKDEL |
| SEQ ID NO: 535 | exemplary cell-targeting molecule 248 | MEVQLVESGGGLVQAGGSLRLSCAASGITFSINTMGWYRQAP GKQRELVALISSIGDTYYADSVKGRFTISRDNAKNTVYLQMN SLKPEDTAVYYCKRFRTAAQGTDYWGQGTQVTVSSAHHSED PSSKAPKAPGILGFVFTLGILGFVFTLKEFTLDFSTAKTYVDSL NVIRSAIGTPLQTISSGGTSLLMIDSGIGDNLFAVDILGFDFTLG RFNNLRLIVERNNLYVTGFVNRTNNVFYRFADFSHVTFPGTT AVTLSADSSYTTLQRVAGISRTGMQINRHSLTTSYLALMSHSG TSLTQSVARAMLRFVTVTAEALRFRQIQRGFRTTLDDLSGASY VMTAEDVDLTLNWGRLSSVLPDYHGQDSVRVGRISFGSINAI LGSVALILNSHHHASAVAAKDEL |
| SEQ ID NO: 536 | exemplary cell-targeting molecule 249 | MEVQLVESGGGLVQAGGSLRLSCAASGITFSINTMGWYRQAP GKQRELVALISSIGDTYYADSVKGRFTISRDNAKNTVYLQMN SLKPEDTAVYYCKRFRTAAQGTDYWGQGTQVTVSSEFPKPST PPGSSGGAPGILGFVFTLGILGFVFTLKEFTLDFSTAKTYVDSL NVIRSAIGTPLQTISSGGTSLLMIDSGIGDNLFAVDILGFDFTLG RFNNLRLIVERNNLYVTGFVNRTNNVFYRFADFSHVTFPGTT AVTLSADSSYTTLQRVAGISRTGMQINRHSLTTSYLALMSHSG TSLTQSVARAMLRFVTVTAEALRFRQIQRGFRTTLDDLSGASY VMTAEDVDLTLNWGRLSSVLPDYHGQDSVRVGRISFGSINAI LGSVALILNSHHHASAVAAKDEL |
| SEQ ID NO: 537 | exemplary cell-targeting molecule 250 | MAPTSSSTKKTQLQLEHLLLDLQMILNGINNYKNPKLTRMLT FKFYMPKKATELKHLQCLEEELKPLEEVLNLAQSKNFHLRPR DLISNINVIVLELKGSETTFMCEYADETATIVEFLNRWITFCQSI ISTLTEFPKPSTPPGSSGGAPGILGFVFTLKEFTLDFSTAKTYVD SLNVIRSAIGTPLQTISSGGTSLLMIDSGIGDNLFAVDILGFDFT LGRFNNLRLIVERNNLYVTGFVNRTNNVFYRFADFSHVTFPG TTAVTLSADSSYTTLQRVAGISRTGMQINRHSLTTSYLALMSH SGTSLTQSVARAMLRFVTVTAEALRFRQIQRGFRTTLDDLSGA SYVMTAEDVDLTLNWGRLSSVLPDYHGQDSVRVGRISFGSIN AILGSVALILNSHHHASAVAAKDEL |
| SEQ ID NO: 538 | exemplary cell-targeting molecule 251 | MAPTSSSTKKTQLQLEHLLLDLQMILNGINNYKNPKLTRMLT FKFYMPKKATELKHLQCLEEELKPLEEVLNLAQSKNFHLRPR DLISNINVIVLELKGSETTFMCEYADETATIVEFLNRWITFCQSI ISTLTEFPKPSTPPGSSGGAPGILGFVFTLKEFTLDFSTAKTYVD SLNVIRSAIGTPLQTISSGGTSLLMIDSGIGDNLFAVDILGFDFT |

-continued

| ID Number | Text Description | Biological Sequence |
|---|---|---|
| | | LGRFNNLRLIVERNNLYVTGFVNRTNNVFYRFADFSHVTFPG<br>TTAVTLSADSSYTTLQRVAGISRTGMQINRHSLTTSYLALMSH<br>SGTSLTQSVARAMLRFVTVTAEALRFRQIQRGFRTTLDDLSGA<br>SYVMTAEDVDLTLNWGRLSSVLPDYHGQDSVRVGRISFGSIN<br>AILGSVALILNCHHASAVAAKDEL |
| SEQ ID NO: 539 | exemplary cell-targeting molecule 252 | MQVQLVQSGAELVKPGASVKMSCKASGYTFTSYNMHWVKQ<br>TPGQGLEWIGAIYPGNGDTSYNQKFKGKATLTADKSSTAYM<br>QLSSLTSEDSAVYYCARAQLRPNYWYFDVWGAGTTVTVSSG<br>STSGSGKPGSGEGSDIVLSQSPAILSASPGEKVTMTCRASSSVS<br>YMHWYQQKPGSSPKPWIYATSNLASGVPARFSGSGSGTSYSL<br>TISRVEAEDAATYYCQQWISNPPTFGAGTKLELKEFPKSTPP<br>GSSGGAPGILGFVFTLKEFTLDFSTAKTYVDSLNVIRSAIGTPL<br>QTISSGGTSLLMIDSGIGDNLFAVDILGFDFTLGRFNNLRLIVER<br>NNLYNTGFVNRTNNVYYRFADFSHVTFPGTTAVLTSADSSYT<br>TLQRVAGISRTGMNQINRHSLTTSYLALMSHSGTSLTQSVARA<br>MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAA |
| SEQ ID NO: 540 | exemplary cell-targeting molecule 253 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS<br>VSYMDWYQQKPGSSPKPWIYATSNLASGVPARFSGSGSGTSY<br>SLTISRVEAEDAATYYCQQWISNPPTFGAGTKLELKEFPKSTP<br>PGSSGGAPGILGFVFTLKEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNVFYRFADFSHVTFPGTTAVTLSADSSY<br>TTLQRVAGISRTGMQINRHSLTTSYLALMSHSGTSLTQSVARA<br>MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAA |
| SEQ ID NO: 541 | exemplary cell-targeting molecule 254 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS<br>VSYMDWYQQKPGSSPKPWIYATSNLASGVPARFSGSGSGTSY<br>SLTISRVEAEDAATYYCQQWISNPPTFGAGTKLELKEFPKSTP<br>PGSSGGAPGILGFVFTLKEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNVFYRFADFSHVTFPGTTAVTLSADSSY<br>TTLQRVAGISRTGMQINRHSLTTSYLALMSHSGTSLTQSVARA<br>MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAA |
| SEQ ID NO: 542 | exemplary cell-targeting molecule 255 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS<br>VSYMDWYQQKPGSSPKPWIYATSNLASGVPARFSGSGSGTSY<br>SLTISRVEAEDAATYYCQQWISNPPTFGAGTKLELKEFPKSTP<br>PGSSGGAPGILGFVFTLKEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNVFYRFADFSHVTFPGTTAVTLSADSSY<br>TTLQRVAGISRTGMQINRHSLTTSYLALMSHSGTSLTQSVARA<br>MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAA |
| SEQ ID NO: 543 | exemplary cell-targeting molecule 256 | MQVQLQQPGAELVKPGASVKMSCKASGYTFTSYNMHWVKQ<br>TPGRGLEWIGAIYPGNGDTSYNQKFKGKATLTADKSSSTAYM<br>QLSSLTSEDSAVYYCARSTYYGGDWYFNVWGAGTTVTVSAG<br>STSGSGKPGSGEGSTKGQIVLSQSPAILSASPGEKVTMTCRASS<br>SVSYIHWFQQKPGSSPKPWIYATSNLASGVPVRFSGSGSGTSY<br>SLTISRVEAEDAATYYCQQWTSNPPTFGGGTKLEIKEFPKSTP<br>PGSSGGAPGILGFVFTLKEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNVFYRFADFSHVTFPGTTAVTLSADSSY<br>TTLQRVAGISRTGMQINRHSLTTSYLALMSHSGTSLTQSVARA |

| | | |
|---|---|---|
| ID Number | Text Description | Biological Sequence |
| | | MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAA |
| SEQ ID NO: 544 | exemplary cell-targeting molecule 257 | MEVQLVESGGGLVQPGRSLRLSCAASGFTFNDYAMHWVRQA<br>PGKGLEWVSTISWNSGSIGYADSVKGRFTISRDNAKKSLYLQ<br>MNSLRAEDTALYYCAKDIQYGNYYYGMDVWGQGTTVTVSS<br>GSTSGSGKPGSGEGSEIVLTQSPATLSLSPGERATLSCRASQSV<br>SSYLAWYQQKPGQAPRLLIYDASNRATGIPARFSGSGSGTDFT<br>LTISSLEPEDFAVYYCQQRSNWPITFGQGTRLEIKEFPKPSTPPG<br>SSGGAPGILGFVFTLKEFTLDFSTAKTYVDSLNVIRSAIGTPLQ<br>TISSGGTSLLMIDSGIGDNLFAVDILGFDFTLGRFNNLRLIVERN<br>NLYVTGFVNRTNNVFYRFADFSHVTFPGTTAVTLSADSSYTT<br>LQRVAGISRTGMQINRHSLTTSYLALMSHSGTSLTQSVARAM<br>LRFVTVTAEALRFRQIQRGFRTTLDDLSGASYVMTAEDVDLT<br>LNWGRLSSVLPDYHGQDSVRVGRISFGSINAILGSVALILNSH<br>HHASAVAA |
| SEQ ID NO: 545 | exemplary cell-targeting molecule 258 | MEIVLTQSPATLSLSPGERATLSCRASQSVSSYLAWYQQKPGQ<br>APRLLIYDASNRATGIPARFSGSGSGTDFTLTISSLEPEDFAVY<br>YCQQRSNWPITFGQGTRLEIKGGGGSGGGGSGGGGSGGGGS<br>GGGSEVQLVESGGGLVQPGRSLRLSCAASGFTFNDYAMHWV<br>RQAPGKGLEWVSTISWNSGSIGYADSVKGRFTISRDNAKKSL<br>YLQMNSLRAEDTALYYCAKDIQYGNYYYGMDVWGQGTTVT<br>VSSEFPKPSTPPGSSGGAPGILGFVFTLKEFTLDFSTAKTYVDS<br>LNVIRSAIGTPLQTISSGGTSLLMIDSGIGDNLFAVDILGFDFTL<br>GRFNNLRLIVERNNLYVTGFVNRTNNVFYRFADFSHVTFPGT<br>TAVTLSADSSYTTLQRVAGISRTGMQINRHSLTTSYLALMSHS<br>GTSLTQSVARAMLRFVTVTAEALRFRQIQRGFRTTLDDLSGAS<br>YVMTAEDVDLTLNWGRLSSVLPDYHGQDSVRVGRISFGSINA<br>ILGSVALILNSHHASAVAA |
| SEQ ID NO: 546 | exemplary cell-targeting molecule 259 | MQIVLSQSPAILSASPGEKVTMTCRASSSVSYMHWYQQKPGS<br>SPKPWIYAPSNLASGVPARFSGSGSGTSYSLTISRVEAEDAATY<br>YCQQWSFNPPTFGAGTKLELKSGGGGSGGGGSGGGGSGGGG<br>SGGGGSQAYLQQSGAELVRPGASVKMSCKASGYTFTSYNMH<br>WVKQTPRQGLEWIGAIYPGNGDTSYNQKFKGKATLTVDKSSS<br>TAYMQLSSLTSEDSAVYFCARVVYYSNSYWYFDVWGTGTTV<br>TVSEFPKPSTPPGSSGGILGFVFTLGAPKEFTLDFSTAKTYVDS<br>LNVIRSAIGTPLQTISSGGTSLLMIDSGIGDNLFAVDILGFDFTL<br>GRFNNLRLIVERNNLYVTGFVNRTNNVFYRFADFSHVTFPGT<br>TAVTLSADSSYTTLQRVAGISRTGMQINRHSLTTSYLALMSHS<br>GTSLTQSVARAMLRFVTVTAEALRFRQIQRGFRTTLDDLSGAS<br>YVMTAEDVDLTLNWGRLSSVLPDYHGQDSVRVGRISFGSINA<br>ILGSVALILNSHHASAVAA |
| SEQ ID NO: 547 | exemplary cell-targeting molecule 260 | MQAYLQQSGAELVRPGASVKMSCKASGYTFTSYNMHWVKQ<br>TPRQGLEWIGAIYPGNGDTSYNQKFKGKATLTVDKSSSTAYM<br>QLSSLTSEDSAVYFCARVVYYSNSYWYTDVWGTGTTVTVSG<br>STSGSGKPGSGEGSQIVLSQSPAILSASPGEKVTMTCRASSSVS<br>YMHWYQQKPGSSPKPWIYAPSNLASGVPARFSGSGSGTSYSL<br>TISRVEAEDAATYYCQQWSFNPPTFGAGTKLELKSEFPKPSTP<br>PGSSGGAPGILGFVFTLKEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNVFYRFADFSHVTFPGTTAVTLSADSSY<br>TTLQRVAGISRTGMQINRHSLTTSYLALMSHSGTSLTQSVARA<br>MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAA |
| SEQ ID NO: 548 | exemplary cell-targeting molecule 261 | ASVSDVPRDLEVVAATPTSLLISWCRQRCADSYRITYGETGGN<br>SPVQEFTVPGSWKTATISGLKPGVDYTITVYVVTHYYGWDRY<br>SHPISINYRTGSEFPKPSTPPGSSGGAPGILGFVFTLKEFTLDFST<br>AKTYVDSLNVIRSAIGTPLQTISSGGTSLLMIDSGIGDNLFAVDI<br>LGFDFTLGRFNNLRLIVERNNLYVTGFVNRTNNVFYRFADFS<br>HVTFPGTTAVTLSADSSYTTLQRVAGISRTGMQINRHSLTTSY<br>LALMSHSGTSLTQSVARAMLRFVTVTAEALRFRQIQRGFRTT<br>LDDLSGASYVMTAEDVDLTLNWGRLSSVLPDYHGQDSVRVG<br>RISFGSINAILGSVALILNSHHASAVAANLVPMVATV |
| SEQ ID NO: 549 | exemplary cell-targeting molecule 262 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS |

| ID Number | Text Description | Biological Sequence |
|---|---|---|
| | | VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLKEFTLDFSTAKTYVDSLNVIRSAIGTP LQTISSGGTSLLMIDSGIGDNEFAVDILGFDFTLGRFNNLRLIVE RNNLYVTGFVNRTNNVFYRFADFSHVTFPGTTAVTLSADSSY TTLQRVAGISRTGMQINRHSLTTSYLALMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAAKDEL |
| SEQ ID NO: 550 | exemplary cell-targeting molecule 263 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPGILGFVFTLMQVQLQQPGAELVKPGASVKMSCK TSGYTFTSYNVHWVKQTPGQGLEWIGAIYPGNGDTSFNQKFK GKATLTADKSSSTVYMQLSSLTSEDSAVYYCARSNYYGSSYV WFFDVWGAGTTVTVSSGSTSGSGKPGSGEGSQIVLSQSPTILS ASPGEKVTMTCRASSSVSYMDWYQQKPGSSPKPWIYATSNL ASGVPARFSGSGSGTSYSLTISRVEAEDAATYYCQQWISNPPT FGAGTKLELK |
| SEQ ID NO: 551 | exemplary cell-targeting molecule 264 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMERFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPGILGFVFTLDIELTQSPSSFSVSLGDRVTITCKASE DIYNRLAWYQQKPGNAPRLLISGATSLETGVPSRFSGSGSGKD YTLSITSLQTEDVATYYCQQYWSTPTFGGGTKLEIKGSTSGSG KPGSGEGSKVQLQESGPSLVQPSQRLSITCTVSGFSLISYGVH WVRQSPGKGLEWLGVIWRGGSTDYNAAFMSRLSITKDNSKS QVFFKMNSLQADDTAIYFCAKTLITTGYAMDYWGQGTTVTV SS |
| SEQ ID NO: 552 | exemplary cell-targeting molecule 265 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPGILGFVFTLDIELTQSPSSFSVSLGDRVTITCKASE DIYNRLAWYQQKPGNAPRLLISGATSLETGVPSRFSGSGSGKD YTLSITSLQTEDVATYYCQQYWSTPTFGGGTKLEIKGSTSGSG KPGSGEGSKVQLQESGPSEVQPSQRLSITCTVSGFSLISYGVH WVRQSPGKGLEWLGVIWRGGSTDYNAAFMSRLSITKDNSKS QVFFKMNSLQADDTAIYFCAKTLITTGYAMDYWGQGTTVTV SS |
| SEQ ID NO: 553 | exemplary cell-targeting molecule 266 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPGILGFVFTLDIQMTQSPSSLSASVGDRVTITCRAS QDVNTAVAWYQQKPGKAPKLLIYSASFLYSGVPSRFSGSRSG TDFTLTISSLQPEDFATYYCQQHYTYPPTFGQGTKVEIKRTGST SGSGKPGSGEGSEVQLVESGGGLVQPGGSLRLSCAASGFNIKD TYIHWVRQAPGKGLEWVARIYPTNGYTRYADSVKGRFTISAD TSKNTAYLQMNSLRAEDTAVYYCSRWGGDGFYAMDVWGQ GTLVTVSS |
| SEQ ID NO: 554 | exemplary cell-targeting molecule 267 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLIDDLSGASYVMTAEDVDLTLNWGRLSSVLPDYH GQDSVRVGRISFGSINAILGSVALILNSHHHASAVAAEFPKPST PPGSSGGAPGILGFVFTLDIQMTQSPSSLSASVGDRVTITCRAS QDVNTAVAWYQQKPGKAPKLLIYSASFLYSGVPSRFSGSRSG |

-continued

| ID Number | Text Description | Biological Sequence |
|---|---|---|
| | | TDFTLTISSLQPEDFATYYCQQHYTTPPTFGQGTKVEIKRTGST SGSGKPGSGEGSEVQLVESGGGLVQPGGSLRLSCAASGFNIKD TYIHWVRQAPGKGLEWVARIYPTNGYTRYADSVKGRFTISAD TSKNTAYLQMNSLRAEDTAVYYCSRWGGDGFYAMDVWGQ GTLVTVSS |
| SEQ ID NO: 555 | exemplary cell-targeting molecule 268 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIVMTQAAPSIPVTPGESVSISCRSSK SLLNSNGNTYLYWFLQRPGQSPQLLIYRMSNLASGVPDRFSGS GSGTAFTLRISRVEAEDVGVYYCMQHLEYPFTFGAGTKLELK GSTSGSGKPGSGEGSEVQLQQSGPELIKPGASVKMSCKASGYT FTSYVMHWVKQKPGQGLEWIGYINPYNDGTKYNEKFKGKAT LTSDKSSSTAYMELSSLTSEDSAVYYCARGTYYYGSRVFDYW GQGTTLTVSS |
| SEQ ID NO: 556 | exemplary cell-targeting molecule 269 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIVMTQAAPSIPVTPGESVSISCRSSK SLLNSNGNTYLYWFLQRPGQSPQLLIYRMSNLASGVPDRFSGS GSGTAFTLRISRVEAEDVGVYYCMQHLEYPFTFGAGTKLELK GSTSGSGKPGSGEGSEVQLQQSGPELIKPGASVKMSCKASGYT FTSYVMHWVKQKPGQGLEWIGYINPYNDGTKYNEKFKGKAT LTSDKSSSTAYMELSSLTSEDSAVYYCARGTYYYGSRVFDYW GQGTTLTVSS |
| SEQ ID NO: 557 | exemplary cell-targeting molecule 270 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRRADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIQLTQSPLSLPVTLGQPASISCRSSQ SLVHRNGNTYLHWFQQRPGQSPRLLIYTVSNRFSGVPDRFSGS GSGTDFTLKISRVEAEDVGVYFCSQSSHVPPTFGAGTRLEIKGS TSGSGKPGSGEGSTKGQVQLQQSGSELKKPGASVKVSCKASG YTFTNYGVNWIKQAPGQGLQWMGWINPNTGEPTFDDDFKGR FAFSLDTSVSTAYLQISSLKADDTAVYFCSRSRGKNEAWFAY WGQGTLVTVSS |
| SEQ ID NO: 558 | exemplary cell-targeting molecule 271 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIQLTQSPLSLPVTLGQPASISCRSSQ SLVHRNGNTYLHWFQQRPGQSPRLLIYTVSNRFSGVPDRFSGS GSGTDFTLKISRVEAEDVGVYFCSQSSHVPPTFGAGTRLEIKGS TSGSGKPGSGEGSTKGQVQLQQSGSELKKPGASVKVSCKASG YTFTNYGVNWIKQAPGQGLQWMGWINPNTGEPTFDDDFKGR FAFSLDTSVSTAYLQISSLKADDTAVYTCSRSRGKNEAWFAY WGQGTLVTVSS |
| SEQ ID NO: 559 | exemplary cell-targeting molecule 272 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAAHHSED PSSKAPKAPGILGFVFTLEVQLVESGGGLVQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |

Sequence Listing

| ID Number | Text Description | Biological Sequence |
|---|---|---|
| SEQ ID NO: 560 | exemplary cell-targeting molecule 273 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPGILGFVFTLEVQLVESGGGLVQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |
| SEQ ID NO: 561 | exemplary cell-targeting molecule 274 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAAHHSED PSSKAPKAPGILGFVFTLEVQLVESGGGLVQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |
| SEQ ID NO: 562 | exemplary cell-targeting molecule 275 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPGILGFVFTLEVQLVESGGGLVQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |
| SEQ ID NO: 563 | exemplary cell-targeting molecule 276 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPGILGFVFTLASVSDVPRDLEVVAATPTSLLISWCR QRCADSYRITYGETGGNSPVQEFTVPGSWKTATISGLKPGVD YTITVYVVTHYYGWDRYSHPISINYRTGS |
| SEQ ID NO: 564 | exemplary cell-targeting molecule 277 | MKEFTLDFSTAKTYVDSLNVIRSAIGTPLQTISSGGTSLLMIDS GIGDNLFAVDILGFDFTLGRFNNLRLIVERNNLYVTGFVNRTN NVFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPGILGFVFTLDIVLTQSPASLAVSLGQRATISCRAT ESVEYYGTSLVQWYQQKPGQPPKLLIYAASSVDSGVPARFSG SGSGTDFSLTIHPVEEDDIAMYFCQQSRRVPYTFGGGTKLEIK GGGGSEVQLQQSGPELVKPGASVKMSCKASGYTFTSYVMHW VKQKPGQGLEWIGYVNPFNDGTKYNEMFKGKATLTSDKSSS TAYMELSSLTSEDSAVYYCARQAWGYPWGQGTLVTVSA |
| SEQ ID NO: 565 | exemplary cell-targeting molecule 278 | VTEHDTLLYKEFTLDFSTAKTYVDSLNVIRSAIGTPLQTISSGG TSLLMIDSGIGDNLFAVDILGFDFTLGRFNNLRLIVERNNLYVT GFVNRTNNAFYRFADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 566 | exemplary cell-targeting molecule 279 | GLDRNSGNYKEFTLDFSTAKTYVDSLNVIRSAIGTPLQTISSGG TSLLMIDSGIGDNLFAVDILGFDFTLGRFNNLRLIVERNNLYVT GFVNRTNNAFYRFADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVMTAEDVDLTLNWGRL |

| ID Number | Text Description | Biological Sequence |
|---|---|---|
| | | SSVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 567 | exemplary cell-targeting molecule 280 | GVMTRGRLKEFTLDFSTAKTYVDSLNVIRSAIGTPLQTISSGGT SLLMIDSGIGDNLFAVDILGFDFTLGRFNNLRLIVERNNLYVTG FVNRTNNAFYRFADFSHVTFPGTTAVTLSADSSYTTLQRVAGI SRTGMQINRHSLTTSYLALMSHSGTSLTQSVARAMLRFVTVT AEALRFRQIQRGFRTTLDDLSGASYVMTAEDVDLTLNWGRLS SVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 568 | exemplary cell-targeting molecule 281 | VYALPLKMLKEFTLDFSTAKTYVDSLNVIRSAIGTPLQTISSGG TSLLMIDSGIGDNLFAVDILGFDFTLGRFNNLRLIVERNNLYVT GFVNRTNNAFYREADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 569 | exemplary cell-targeting molecule 282 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNAFYRFADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGSTSGSG KPGSGEGSTKGQVQLQESGPGLVRPSQTLSLTCTVSGFSLTSY GVHWVRQPPGRGLEWIGVMWRGGSTDYNAAFMSRLNITKD NSKNQVSLRLSSVTAADTAVYYCAKSMITTGFVMDSWGQGS LVTVSS |
| SEQ ID NO: 570 | exemplary cell-targeting molecule 283 | GILGFVFTLAEFTLDFSTAKTYVDSLNVIRSAIGTPLQTISSGGT SLLMIDSGIGDNLFAVDILGFDFTLGRFNNLRLIVERNNLYVTG FVNRTNNAFYRFADFSHVTFPGTTAVTLSADSSYTTLQRVAGI SRTGMQINRHSLTTSYLALMSHSATSLTQSVARAMLRFVTVT AEALRFRQIQRGFRTTLDDLSGRSYVMTAEDVDLTLNWGRLS SVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGSTSGSG KPGSGEGSTKGQVQLQESGPGLVRPSQTLSLTCTVSGFSLTSY GVHWVRQPPGRGLEWIGVMWRGGSTDYNAAFMSRLNITKD NSKNQVSLRLSSVTAADTAVYYCAKSMITTGFVMDSWGQGS LVTVS |
| SEQ ID NO: 571 | exemplary cell-targeting molecule 284 | DIQMTQSPSSLSASVGDRVTITCRASQDVNTAVAWYQQKPGK APKLLIYSASFLYSGVPSRFSGSRSGTDFTLTISSLQPEDFATYY CQQHYTTPPTFGQGTKVEIKRTGSTSGSGKPGSGEGSEVQLVE SGGGLVQPGGSLRLSCAASGFNIKDTYIHWVRQAPGKGLEWV ARIYPTNGYTRYADSVKGRFTISADTSKNTAYLQMNSLRAED TAVYYCSRWGGDGFYAMDVWGQGTLVTVSSEFPKPSTPPGS SGGAPGILGFVFTLKEFTLDFSTAKTYVDSLNVIRSAIGTPLQTI SSGGTSLLMIDSGIGDNLFAVDILGFDFTLGRFNNLRLIVERNN LYVTGFVNRTNNAFYRFADFSHVTFPGTTAVTLSADSSYTTL QRVAGISRTGMQINRHSLTTSYLALMSHSGTSLTQSVARAML |

| ID Number | Text Description | Biological Sequence |
|---|---|---|
| | | RFVTVTAEALRFRQIQRGFRTTLDDLSGASYVMTAEDVDLTL<br>NWGRLSSVLPDYHGQDSVRVGRISFGSINAILGSVALILNSHH<br>HASAVAA |
| SEQ ID NO: 572 | exemplary cell-targeting molecule 285 | QVQLQQPGAELVKPGASVKMSCKTSGYTFTSYNVHWVKQTP<br>GQGLEWIGAIYPGNGDTSFNQKFKGKATLTADKSSSTVYMQL<br>SSLTSEDSAVYYCARSNYYGSSYVWFFDVWGAGTTVTVSSGS<br>TSGSGKPGSGEGSQIVLSQSPTILSASPGEKVTMTCRASSSVSY<br>MDWYQQKPGSSPKPWIYATSNLASGVPARFSGSGSGTSYSLTI<br>SRVEAEDAATYYCQQWISNPPTFGAGTKLELKEFPKPSTPPGS<br>SGGAPGILGFVFTLKEFTLDFSTAKTYVDSLNVIRSAIGTPLQTI<br>SSGGTSLLMIDSGIGDNLFAVDILGFDFTLGRFNNLRLIVERNN<br>LYVTGFVNRTNNAFYRFADFSHVTFPGTTAVTLSADSSYTTL<br>QRVAGISRTGMQINRHSLTTSYLALMSHSGTSLTQSVARAML<br>RFVTVTAEALRFRQIQRGFRTTLDDLSGASYVMTAEDVDLTL<br>NWGRLSSVLPDYHGQDSVRVGRISFGSINAILGSVALILNSHH<br>HASAVAA |
| SEQ ID NO: 573 | exemplary cell-targeting molecule 286 | KEFTLDFSTAKTYVDSLNVIRSAIGTPLQTISSGGTSLLMIDSGI<br>GDNLFAVDILGFDFTLGRFNNLRLIVERNNLYVTGFVNRTNN<br>AFYRFADFSHVTFPGTTAVTLSADSSYTTLQRVAGISRTGMQI<br>NRHSLTTSYLALMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHHASAVAAEFPKPST<br>PPGSSGGAPDIQMTQSPSSLSASVGDRVTITCKASEDIYNRLT<br>WYQQKPGKAPKLLISGATSLETGVPSRFSGSGSGTDFTFTISSL<br>QPEDIATYYCQQYWSNPYTFGQGTKVEIKGGGGSQVQLQESG<br>PGLVRPSQTLSLTCTVSGFSLTSYGVHWVRQPPGRGLEWIGV<br>MWRGGSTDYNAAFMSRLNITKDNSKNQVSLRLSSVTAADTA<br>VYYCAKSMITTGFVMDSWGQGSLVTVSSVTEHDTELY |
| SEQ ID NO: 574 | exemplary cell-targeting molecule 287 | KEFTLDFSTAKTYVDSLNVIRSAIGTPLQTISSGGTSLLMIDSGI<br>GDNLFAVDILGFDFTLGRFNNLRLIVERNNLYVTGFVNRTNN<br>AFYRFADFSHVTFPGTTAVTLSADSSYTTLQRVAGISRTGMQI<br>NRHSLTISYLALMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHHASAVAAEFPKPST<br>PPGSSGGAPDIQMTQSPSSLSASVGDRVTITCKASEDIYNRLT<br>WYQQKPGKAPKLLISGATSLETGVPSRFSGSGSGTDFTFTISSL<br>QPEDIATYYCQQYWSNPYTFGQGTKVEIKGGGGSQVQLQESG<br>PGLVRPSQTLSLTCTVSGFSLTSYGVHWVRQPPGRGLEWIGV<br>MWRGGSTDYNAAFMSRLNITKDNSKNQVSLRLSSVTAADTA<br>VYYCAKSMITTGFVMDSWGQGSLVTVSSNLVPMVATV |
| SEQ ID NO: 575 | exemplary cell-targeting molecule 288 | KEFTLDFSTAKTYVDSLNVIRSAIGTPLQTISSGGTSLLMIDSGI<br>GDNLFAVDILGFDFTLGRFNNLRLIVERNNLYVTGFVNRTNN<br>AFYRFADFSHVTFPGTTAVTLSADSSYTTLQRVAGISRTGMQI<br>NRHSLTTSYLALMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHHASAVAAEFPKPST<br>PPGSSGGAPDIQMTQSPSSLSASVGDRVTITCKASEDIYNRLT<br>WYQQKPGKAPKLLISGATSLETGVPSRFSGSGSGTDFTFTISSL<br>QPEDIATYYCQQYWSNPYTFGQGTKVEIKGGGGSQVQLQESG<br>PGLVRPSQTLSLTCTVSGFSLTSYGVHWVRQPPGRGLEWIGV<br>MWRGGSTDYNAAFMSRLNITKDNSKNQVSLRLSSVTAADTA<br>VYYCAKSMITTGFVMDSWGQGSLVTVSSQYDPVAALF |
| SEQ ID NO: 576 | exemplary cell-targeting molecule 289 | KEFTLDFSTAKTYVDSLNVIRSAIGTPLQTISSGGTSLLMIDSGI<br>GDNLFAVDILGFDFTLGRFNNLRLIVERNNLYVTGFVNRTNN<br>AFYRFADFSHVTFPGTTAVTLSADSSYTTLQRVAGISRTGMQI<br>NRHSLTTSYLALMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHHASAVAAEFPKPST<br>PPGSSGGAPDIQMTQSPSSLSASVGDRVTITCKASEDIYNRLT<br>WYQQKPGKAPKLLISGATSLETGVPSRITSGSGSGTDFTFTISSL<br>QPEDIATYYCQQYWSNPYTFGQGTKVEIKGGGGSQVQLQESG<br>PGLVRPSQTLSLTCTVSGFSLTSYGVHWVRQPPGRGLEWIGV<br>MWRGGSTDYNAAFMSRLNITKDNSKNQVSLRLSSVTAADTA<br>VYYCAKSMITTGFVMDSWGQGSLVTVSSCLGGLLTMV |
| SEQ ID NO: 577 | exemplary cell-targeting molecule 290 | KEFTLDFSTAKTYVDSLNVIRSAIGTPLQTISSGGTSLLMIDSGI<br>GDNLFAVDILGFDFTLGRFNNLRLIVERNNLYVTGFVNRTNN<br>AFYRFADFSHVTFPGTTAVTLSADSSYTTLQRVAGISRTGMQI<br>NRHSLTTSYLALMSHSGTSLTQSVARAMLRFVTVTAEALRFR |

-continued

Sequence Listing

| ID Number | Text Description | Biological Sequence |
|---|---|---|
| | | QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNYPTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSILRGSVAHK |
| SEQ ID NO: 578 | exemplary cell-targeting molecule 291 | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNYPTFGQGTKVEIKGSTSGSGKPGSGE GSTKGQVQLQESGPGLVRPSQTLSLTCTVSGFSLTSYGVHWV RQPPGRGLEWIGVMWRGGSTDYNAAFMSRLNITKDNSKNQV SLRLSSVTAADTAVYYCAKSMITTGFVMDSWGQGSLVTVSSN LVPMVATV |
| SEQ ID NO: 579 | exemplary cell-targeting molecule 292 | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCRASQDVNTAVA WYQQKPGKAPKLLIYSASFLYSGVPSRFSGSRSGTDFTLTISSL QPEDFATYYCQQHYTTPPTFGQGTKVEIKGGGGSEVQLVESG GGLVQPGGSLRLSCAASGFNIKDTYIHWVRQAPGKGLEWVA RTYPTNGYTRYADSVKGRFTISADTSKNTAYLQMNSLRAEDT AVYYCSRWGGDGFYAMDYWGQGTLVTVSSNLVPMVATV |
| SEQ ID NO: 580 | exemplary cell-targeting molecule 293 | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPEVQLVESGGGLVQPGGSLRLSCAASGFTFSDSWI HWVRQAPGKGLEWVAWISPYGGSTYYADSVKGRFTISADTS KNTAYLQMNSLRAEDTAVYYCARRHWPGGFDYWGQGTLVT VSSGGGGSGGGGSGGGGSGGGGSGGGGSDIQMTQSPSSLSAS VGDRVTITCRASQDVSTAVAWYQQKPGKAPKLLIYSASFLYS GVPSRFSGSGSGTDFTLTISSLQPEDFATYYCQQYLYHPATFG QGTKVEIKGILGFVFTL |
| SEQ ID NO: 581 | exemplary cell-targeting molecule 294 | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCRASQGISSWLA WYQQKPEKAPKSLIYAASSLQSGVPSRFSGSGSGTDFTLTISSL QPEDFATYYCQQYNSYPYTFGQGTKLEIKGGGGSQVQLVQSG AEVKKPGASVKVSCKASGYTFTSYDVHWVRQAPGQRLEWM GWLHADTGITKFSQKFQGRVTITRDTSASTAYMELSSLRSEDT AVYYCARERIQLWFDYWGQGTLVTVSSNLVPMVATV |
| SEQ ID NO: 582 | exemplary cell-targeting molecule 295 | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNYPTFGQGTKVEIKGGGGSQVQLQESG |

| | | |
|---|---|---|
| ID Number | Text Description | Biological Sequence |
| | | PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSNLVPMVATV |
| SEQ ID NO: 583 | exemplary cell-targeting molecule 296 | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPQVQLQQPGAELVKPGASVKMSCKTSGYTFTSYN VHWVKQTPGQGLEWIGAIYPGNGDTSFNQKFKGKATLTADK SSSTVYMQLSSLTSEDSAVYYCARSNYYGSSYVWFFDVWGA GTTVTVSSGSTSGSGKPGSGEGSQIVLSQSPTILSASPGEKVTM TCRASSSVSYMDWYQQKPGSSPKPWIYATSNLASGVPARFSG SGSGTSYSLTISRVEAEDAATYYCQQWISNPPTFGAGTKLELK NLVPMVATV |
| SEQ ID NO: 584 | exemplary cell-targeting molecule 297 | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPQVQLVQSGAELVKPGASVKMSCKASGYTFTSYN MHWVKQTPGQGLEWIGAIYPGNGDTSYNQKFKGKATLTADK SSSTAYMQLSSLTSEDSAVYYCARAQLRPNYWYFDVWGAGT TVTVSSGGGGSDIVLSQSPAILSASPGEKVTMTCRASSSVSYM HWYQQKPGSSPKPWIYATSNLASGVPARFSGSGSGTSYSLTIS RVEAEDAATYYCQQWISNPPTFGAGTKLELKNLVPMVATV |
| SEQ ID NO: 585 | exemplary cell-targeting molecule 298 | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPQVQLQQPGAELVKPGASVKMSCKASGYTFTSYN MHWVKQTPGRGLEWIGAIYPGNGDTSYNQKFKGKATLTADK SSSTAYMQLSSLTSEDSAVYYCARSTYYGGDWYFNVWGAGT TVTVSAGSTSGSGKPGSGEGSTKGQIVLSQSPAILSASPGEKVT MTCRASSSVSYIHWFQQKPGSSPKPWIYATSNLASGVPVRFSG SGSGTSYSLTISRVEAEDAATYYCQQWTSNPPTFGGGTKLEIK NLVPMVATV |
| SEQ ID NO: 586 | exemplary cell-targeting molecule 299 | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPEVQLVESGGGLVQAGGSLRLSCAASGITFSINTM GWYRQAPGKQRELVALISSIGDTYYADSVKGRFTISRDNAKN TVYLQMNSLKPEDTAVYYCKRFRTAAQGTDYWGQGTQVTV SSAHHSEDNLVPMVATV |
| SEQ ID NO: 587 | exemplary cell-targeting molecule 300 | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIELTQSPSSFSVSLGDRVTITCKASEDIYNRLAW YQQKPGNAPRLLISGATSLETGVPSRFSGSGSGKDYTLSITSLQ TEDVATYYCQQYWSTPTFGGGTKLEIKGSTSGSGKPGSGEGS KVQLQESGPSLVQPSQRLSITCTVSGFSLISYGVHWVRQSPGK GLEWLGVIWRGGSTDYNAAFMSRLSITKDNSKSQVFFKMNSL QADDTAIYFCAKTLITTGYAMDYWGQGTTVTVSSNLVPMVA TV |
| SEQ ID NO: 588 | exemplary cell-targeting molecule 301 | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSVARAMLRFVTVTAEALRFR |

-continued

| | | |
|---|---|---|
| ID Number | Text Description | Biological Sequence |
| | | QIQRGFRTTLDDLSGASYVMTAEDVDLTLNWGRLSSVLPDYH GQDSVRVGRISFGSINAILGSVALILNSHHHASAVAAAHHSED PSSKAPKAPEVQLVESGGGLVQAGGSLRLSCAASGITFSINTM GWYRQAPGKQRELVALISSIGDTYYADSVKGRFTISRDNAKN TVYLQMNSLKPEDTAVYYCKRFRTAAQGTDYWGQGTQVTV SSNLVPMVATV |
| SEQ ID NO: 589 | exemplary cell-targeting molecule 302 | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPDIVLTQSPASLAVSLGQRATISCRATESVEYYGTS LVQWYQQKPGQPPKLLIYAASSVDSGVPARFSGSGSGTDFSLT IHPVEEDDIAMYFCQQSRRVPYTFGGTKLEIKGGGGSEVQLQ QSGPELVKPGASVKMSCKASGYTFTSYVMHWVKQKPGQGLE WIGYVNPFNDGTKYNEMFKGKATLTSDKSSSTAYMELSSLTS EDSAVYYCARQAWGYPWGQGTLVTVSANLVPMVATV |
| SEQ ID NO: 590 | exemplary cell-targeting molecule 303 | ASVSDVPRDLEVVAATPTSLLISWCRQRCADSYRITYGETGGN SPVQEFTVPGSWKTATISGLKPGVDYTITVYVVTHYYGWDRY SHPISINYRTGSEFPKPSTPPGSSGGAPKEFTLDFSTAKTYVDSL NVIRSAIGTPLQTISSGGTSLLMIDSGIGDNLFAVDILGFDFTLG RFNNLRLIVERNNLYVTGFVNRTNNAFYRFADFSHVTFPGTT AVTLSADSSYTTLQRVAGISRTGMQINRHSLTTSYLALMSHSG TSLTQSVARAMLRFVTVTAEALRFRQIQRGFRTTLDDLSGASY VMTAEDVDLTLNWGRLSSVLPDYHGQDSVRVGRISFGSINAI LGSVALILNCHHASAVAAANLVPMVATVNLVPMVATV |
| SEQ ID NO: 591 | exemplary cell-targeting molecule 304 | KEFTLDFSTAKTYVDSLNVIRSAIGTPLQTISSGGTSLLMIDSGI GDNLFAVDILGFDFTLGRFNNLRLIVERNNLYVTGFVNRTNN AFYRFADFSHVTFPGTTAVTLSADSSYTTLQRVAGISRTGMQI NRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPDIVLTQSPASLAVSLGQRATISCRATESVEYYGTS LVQWYQQKPGQPPKLLIYAASSVDSGVPARFSGSGSGTDFSLT IHPVEEDDIAMYFCQQSRRVPYTFGGGTKLEIKGGGGSEVQLQ QSGPELVKPGASVKMSCKASGYTFTSYVMHWVKQKPGQGLE WIGYVNPFNDGTKYNEMFKGKATLTSDKSSSTAYMELSSLTS EDSAVYYCARQAWGYPWGQGTLVTVSANLVPMVATV |
| SEQ ID NO: 592 | exemplary cell-targeting molecule 305 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNAFYRFADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AGGGGSGGDIQMTQSPSSLSASVGDRVTITCKASEDIYNRLTW YQQKPGKAPKLLISGATSLETGVPSRESGSGSGTDFTFTISSLQ PEDIATYYCQQYWSNPYTFGQGTKVEIKGGGGSQVQLQESGP GLVRPSQTLSLTCTVSGFSLTSYGVHWVRQPPGRGLEWIGVM WRGGSTDYNAAFMSRLNITKDNSKNQVSLRLSSVTAADTAV YYCAKSMITTGFVMDSWGQGSLVTVSS |
| SEQ ID NO: 593 | exemplary cell-targeting molecule 306 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNAFYRFADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKLLISGATSLETGVPSRFSGSGSGTD FTFTISSLQPEDIATYYCQQYWSNPYTFGQGTKVEIKGSTSGSG KPGSGEGSTKGQVQLQESGPGLVRPSQTLSLTCTVSGFSLTSY GVHWVRQPPGRGLEWIGVMWRGGSTDYNAAFMSRLNITKD NSKNQVSLRLSSVTAADTAVYYCAKSMITTGFVMDSWGQGS LVTVSS |
| SEQ ID NO: 594 | exemplary cell-targeting molecule 307 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNAFYRFADFSHVTFPGTTAVTLSADSSYTTLQRVA GISRTGMQINRHSLTTSYLALMSHSGTSLTQSVARAMLRFVTV |

| ID Number | Text Description | Biological Sequence |
|---|---|---|
| | | TAEALRFRQIQRGFRTTLDDLSGASYVMTAEDVDLTLNWGRL SSVLPDYHGQDSVRVGRISFGSINAILGSVALILNSHHHASAVA AEFPKPSTPPGSSGGAPDIQMTQSPSSLSASVGDRVTITCRASQ DVNTAVAWYQQKPGKAPKLLIYSASFLYSGVPSRFSGSRSGT DFTLTISSLQPEDFATYYCQQHYTTPPTFGQGTKVEIKGGGGS EVQLVESGGGLVQPGGSLRLSCAASGFNIKDTYIHWVRQAPG KGLEWVARTYPTNGYTRYADSVKGRFTISADTSKNTAYLQM NSLRAEDTAVYYCSRWGGDGFYAMDYWGQGTLVTVSS |
| SEQ ID NO: 595 | exemplary cell-targeting molecule 308 | GILGFVFTLKEFTLDFSTAKTYVDSLNVIRSAIGTPLQTISSGGT SLLMIDSGIGDNLFAVDILGFDFTLGRFNNLRLIVERNNLYVTG FVNRTNNAFYRFADFSHVTFPGTTAVTLSADSSYTTLQRVAGI SRTGMQINRHSLTTSYLALMSHSGTSLTQSVARAMLRFVTVT AEALRFRQIQRGFRTTLDDLSGASYVMTAEDVDLTLNWGRLS SVLPDYHGQDSVRVGRISFGSINAILGSVALILNSHHHASAVA AEFPKPSTPPGSSGGAPEVQLVESGGGLVQPGGSLRLSCAASG FTFSDSWIHWVRQAPGKGLEWVAWISPYGGSTYYADSVKGR FTISADTSKNTAYLQMNSLRAEDTAVYYCARRHWPGGFDYW GQGTLVTVSSGGGGSGGGGSGGGGSGGGGSGGGGSDIQMTQ SPSSLSASVGDRVTITCRASQDVSTAVAWYQQKPGKAPKLLIY SASFLYSGVPSRFSGSGSGTDFTLTISSLQPEDFATYYCQQYLY HPATFGQGTKVEIK |
| SEQ ID NO: 596 | exemplary cell-targeting molecule 309 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNAFYRFADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AGGGGSGGDIQMTQSPSSLSASVGDRVTITCRASQGISSWLA WYQQKPEKAPKSLIYAASSLQSGVPSRFSGSGSGTDFTLTISSL QPEDFATYYCQQYNSYPYTFGQGTKLEIKGGGGSQVQLVQSG AEVKKPGASVKVSCKASGYTFTSYDVHWVRQAPGQRLEWM GWLHADTGITKFSQKFQGRVTITRDTSASTAYMELSSLRSEDT AVYYCARERIQLWFDYWGQGTLVTVSS |
| SEQ ID NO: 597 | exemplary cell-targeting molecule 310 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNAFYRFADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AEFPKPSTPPGSSGGAPDIQMTQSPSSLSASVGDRVTITCKASE DIYNRLTWYQQKPGKAPKILLISGATSLETGVPSRFSGSGSGTD FTFTISSLQPEDIATYYCQQYWSNPYTFGQGTKVEIKGGGGSQ VQLQESGPGLVRPSQTLSLTCTVSGFSLTSYGVHWVRQPPGR GLEWIGVMWRGGSTDYNAAFMSRLNITKDNSKNQVSLRLSS VTAADTAVYYCAKSMITTGFVMDSWGQGSLVTVSS |
| SEQ ID NO: 598 | exemplary cell-targeting molecule 311 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNAFYRFADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AEFPKPSTPPGSSGGAPQVQLQQPGAELVKPGASVKMSCKTS GYTFTSYNVHWVKQTPGQGLEWIGAIYPGNGDTSFNQKFKG KATLTADKSSSTVYMQLSSLTSEDSAVYYCARSNYYGSSYV WFFDVWGAGTTVTVSSGSTSGSGKPGSGEGSQIVLSQSPTILS ASPGEKVTMTCRASSSVSYMDWYQQKPGSSPKPWIYATSNL ASGVPARFSGSGSGTSYSLTISRVEAEDAATYYCQQWISNPPT FGAGTKLELK |
| SEQ ID NO: 599 | exemplary cell-targeting molecule 312 | NLVPMVATVKEFTLDFSTAKTYVDSLNVIRSAIGTPLQTISSGG TSLLMIDSGIGDNLFAVDILGFDFTLGRFNNLRLIVERNNLYVT GFVNRTNNAFYRFADFSHVTFPGTTAVTLSADSSYTTLQRVA GISRTGMQINRHSLTTSYLALMSHSGTSLTQSVARAMLRFVTV TAEALRFRQIQRGFRTTLDDLSGASYVMTAEDVDLTLNWGRL SSVLPDYHGQDSVRVGRISFGSINAILGSVALILNSHHHASAVA AGGGGSGGQVQLVQSGAELVKPGASVKMSCKASGYTFTSYN MHWVKQTPGQGLEWIGAIYPGNGDTSYNQKFKGKATLTADK SSSTAYMQLSSLTSEDSAVYYCARAQLRPNYWYFDVWGAGT |

| | Sequence Listing | |
|---|---|---|
| ID Number | Text Description | Biological Sequence |
| | | TVTVSSGGGGSGGGGSGGGGSGGGGSGGGGSDIVLSQSPAILS ASPGEKVTMTCRASSSVSYMHWYQQKPGSSPKPWIYATSNL ASGVPARFSGSGSGTSYSLTISRVEAEDAATYYCQQWISNPPT FGAGTKLELK |
| SEQ ID NO: 600 | exemplary cell-targeting molecule 313 | APTSSSTKKTQLQLEHLLLDLQMILNGINNYKNPKLTRMLTFK FYMPKKATELKHLQCLEEELKPLEEVLNLAQSKNFHLRPRDLI SNINVIVLELKGSETTFMCEYADETATIVEFLNRWITFCQSIIST LTEFPKPSTPPGSSGGAPNLVPMIVATVKEFTLDFSTAKTYVDS LNVIRSAIGTPLQTISSGGTSLLMIDSGIGDNLFAVDILGEDFTL GRFNNLRLIVERNNLYVTGFVTNRTNNAFYRFADFSHVTFPGT TAVTLSADSSYTTLQRVAGISRTGMQINRHSLTTSYLALMSHS GTSLTQSVARAMLRFVTVTAEALRFRQIQRGFRTTLDDLSGAS YVMTAEDVDLTLNWGRLSSVLPDYHGQDSVRVGRISFGSINA ILGSVALILNSHHHASAVAA |
| SEQ ID NO: 601 | exemplary cell-targeting molecule 314 | GILGFVFTLKEFTLDFSTAKTYVDSLNVIRSAIGTPLQTISSGGT SLLMIDSGIGDNLFAVIDILGFDFTLGRFNNLRLIVERNNLYVTG FVNRTNNAFYRFADFSHVTFPGTTAVTLSADSSYTTLQRVAGI SRTGMQINRHSLTTSYLALMSHSGTSLTQSVARAMLRFVTVT AEALRFRQIQRGFRTTLDDLSGASYVMTAEDVDLTLNWGRLS SVLPDYHGQDSVRVGRISFGSINAILGSVALILNSHHHASAVA AEFPKPSTPPGSSGGAPAPTSSSTKKTQLQLEHLLLDLQMILNG INNYKNPKLTRMLTFKFYMPKKATELKHLQCLEEELKPLEEV LNLAQSKNFHLRPRDLISNINVIVLELKGSETTFMCEYADETA TIVEFLNRWITFCQSIISTLT |
| SEQ ID NO: 602 | exemplary cell-targeting molecule 315 | MNLVPMVATVKEFTLDFSTAKTYVDSLNVIRSAIGTPLQTISS GGTSLLMIDSGIGDNLFAVDILGFDFTLGRFNNLRLIVERNNLY VTGFVNRTNNAFYRFADFSHVTFPGTTAVTLSADSSYTTLQR VAGISRTGMQINRHSLTTSYLALMSHSGTSLTQSVARAMLRF VTVTAEALRFRQIQRGFRTTLDDLSGASYVMTAEDVDLTLNW GRLSSVLPDYHGQDSVRVGRISFGSINAILGSVALILNSHHHAS AVAAEFPKPSTPPGSSGGAPDIQMTQSPSSLSASVGDRVTITCK ASEDIYNRLTWYQQKPGKAPKLLISGATSLETGVPSRFSGSGS GTDFTFTISSLQPEDIATYYCQQYWSNPYTFGQGTKVEIKGSTS GSGKPGSGEGSTKGQVQLQESGPGLVRPSQTLSLTCTVSGFSL TSYGVHWVRQPPGRGLEWIGVMWRGGSTDYNAAFMSRLNIT KDNSKNQVSLRLSSVTAADTAVYYCAKSMFTTGFVMDSWGQ GSLVTVSS |
| SEQ ID NO: 603 | exemplary cell-targeting molecule 316 | MNLVPMVATVKEFTLDFSTAKTYVDSLNVIRSAIGTPLQTISS GGTSLLMIDSGIGDNLFAVDILGFDFTLGRFNNLRLIVERNNLY VTGFVNRTNNAFYRFADFSHVTFPGTTAVTLSADSSYTTLQR VAGISRTGMQINRHSLTTSYLALMSHSGTSLTQSVARAMLRF VTVTAEALRFRQIQRGFRTTLDDLSGASYVMTAEDVDLTLNW GRLSSVLPDYHGQDSVRVGRISFGSINAILGSVALILNSHHHAS AVAAEFPKPSTPPGSSGGAPDIQMTQSPSSLSASVGDRVTITCK ASEDIYNRLTWYQQKPGKAPKLLISGATSLETGVPSRFSGSGS GTDFTFTISSLQPEDIATYYCQQYWSNPYTFGQGTKVEIKGSTS GSGKPGSGEGSTKGQVQLQESGPGLVRPSQTLSLTCTVSGFSL TSYGVHWVRQPPGRGLEWIGVMWRGGSTDYNAAFMSRLNIT KDNSKNQVSLRLSSVTAADTAVYYCAKSMITTGFVMDSWGQ GSLVTVSS |
| SEQ ID NO: 604 | exemplary cell-targeting molecule 317 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGSTSGSGKPGSGE GSTKGQVQLQESGPGLVRPSQTLSLTCTVSGFSLTSYGVHWV RQPPGRGLEWIGVMWRGGSTDYNAAFMSRLNITKDNSKNQV SLRLSSVTAADTAVYYCAKSMITTGFVMDSWGQGSLVTVSSN LVPMVATV |
| SEQ ID NO: 605 | exemplary cell-targeting molecule 318 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH |

| | Sequence Listing | |
|---|---|---|
| ID Number | Text Description | Biological Sequence |
| | | GQDSVRVGRISFGSINAILGSVALILNSHHHASAVAAEFPKPST<br>PPGSSGGAPDIQMTQSPSSLSASVGDRVTITFCKASEDIYNRLT<br>WYQQKPGKAPKLLISGATSLETGVPSRFSGSGSGTDFTFTISSL<br>QPEDIATYYCQQYWSNPYTFGQGTKVEIKGSTSGSGKPGSGE<br>GSTKGQVQLQESGPGLVRPSQTLSLTCTVSGFSLTSYGVHWV<br>RQPPGRGLEWIGVMWRGGSTDYNAAFMSRLNITKDNSKNQV<br>SLRLSSVTAADTAVYYCAKSMITTGFVMDSWGQGSLVTVSSN<br>LVPMVATV |
| SEQ ID<br>NO: 606 | exemplary<br>cell-targeting<br>molecule 319 | MGILGFVFTLKEFTLDFSTAKTYNDSLNVIRSAIGTPLQTISSG<br>GTSLLMIDSGIGDNLFAVDILGFDFTLGRFNNLRLIVERNNLYV<br>TGFVNRTNNAFYRFADFSHVTFPGTTAVTLSADSSYTTLQRV<br>AGISRTGMQINRHSLTTSYLALMSHSGTSLTQSVARAMLRFVT<br>VTAEALRERQIQRGFRTTLDDLSGASYVMTAEDVDLTLNWG<br>RLSSVLPDYHGQDSVRVGRISFGSINAILGSVALILNSHHASA<br>VAAEFPKPSTPPGSSGGAPDIQMTQSPSSLSASVGDRVTITCKA<br>SEDIYNRLTWYQQKPGKAPKLLISGATSLETGVPSRFSGSGSG<br>TDFTFTISSLQPEDIATYYCQQYWSNPYTFGQGTKVEIKGSTSG<br>SGKPGSGEGSTKGQVQLQESGPGLVRPSQTLSLTCTVSGFSLT<br>SYGVHWVRQPPGRGLEWIGVMWRGGSTDYNAAFMSRLNIT<br>KDNSKNQVSLRLSSVTAADTAVYYCAKSMITTGFVMDSWGQ<br>GSLVTVSS |
| SEQ ID<br>NO: 607 | exemplary<br>cell-targeting<br>molecule 320 | MDIQMTQSPSSLSASVGDRVTITCRASQDVNTAVAWYQQKP<br>GKAPKLLIYSASFLYSGVPSRFSGSRSGTDFTLTISSLQPEDFAT<br>YYCQQHYTTPPTFGQGTKVEIKRTGSTSGSGKPGSGEGSEVQL<br>VESGGGLVQPGGSLRLSCAASGFNIKDTYIHWVRQAPGKGLE<br>WVARIYPTNGYTRYADSVKGRFTISADTSKNTAYLQMNSLRA<br>EDTAVYYCSRWGGDGFYAMDVWGQGTLVTVSSEFPKPSTPP<br>GSSGGAPGILGFVFTLKEFTLDFSTAKTYVDSLNVIRSAIGTPL<br>QTISSGGTSLLMIDSGIGDNLFAVDILGFDFTLGRFNNLRLIVER<br>NNLYVTGFVNRTNNAFYRFADFSHVTFPGTTAVTLSADSSYT<br>TLQRVAGISRTGMQINRHSLTTSYLALMSHSGTSLTQSVARA<br>MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAA |
| SEQ ID<br>NO: 608 | exemplary<br>cell-targeting<br>molecule 321 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS<br>VSYMDWYQQKPGSSPKWIYATSNLASGVPARFSGSGSGTSY<br>SLTISRVEAEDAATYYCQQWISNPPTFGAGTKLELKEFPKPSTP<br>PGSSGGAPGILGFVFTLKEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNAFYRFADFSHVTFPGTTAVTLSADSSY<br>TTLQRVAGISRTGMQINRHSLTTSYLALMSHSGTSLTQSVARA<br>MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAA |
| SEQ ID<br>NO: 609 | exemplary<br>cell-targeting<br>molecule 322 | MKEFTLDFSTAKTYVDSLNVIRSAIGTPLQTISSGGTSLLMIDS<br>GIGDNLFAVDILGFDFTLGRFNNLRLIVERNNLYVTGFVNRTN<br>NAFYRFADFSHVTFPGTTAVTLSADSSYTTLQRVAGISRTGMQ<br>INRHSLTTSYLALMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHASAVAAEFPKPST<br>PPGSSGGAPDIQMTQSPSSLSASVGDRVTITCRASQDVNTAVA<br>WYQQKPGKAPKLLIYSASFLYSGVPSRFSGSRSGTDFTLTISSL<br>QPEDFATYYCQQHYTTPPTFGQGTKVEIKGGGGSEVQLVESG<br>GGLVQPGGSLRLSCAASGFNIKDTYIHWVRQAPGKGLEWVA<br>RIYPTNGYTRYADSVKGRFTISADTSKNTAYLQMNSLRAEDT<br>AVYYCSRWGGDGFYAMDYWGQGTLVTVSSNLVPMVATV |
| SEQ ID<br>NO: 610 | exemplary<br>cell-targeting<br>molecule 323 | MKEFTLDFSTAKTYVDSLNVIRSAIGTPLQTISSGGTSLLMIDS<br>GIGDNLFAVDILGFDFTLGRFNNLRLIVERNNLYVTGGVNRTN<br>NAFYRFADFSHVTFPGTTAVTLSADSSYTTLQRVAGISRTGMQ<br>INRHSLTTSYLALMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHASAVAAEFPKPST<br>PPGSSGGAPEVQLVESGGGLVQPGGSLRLSCAASGPTFSDSWI<br>HWVRQAPGKGLEWVAWISPYGGSTYYADSVKGRFTISADTS<br>KNTAYLQMNSLRAEDTAVYYCARRHWPGGFDYWGQGTLVT<br>VSSGGGGSGGGGSGGGGSGGGGSGGGGSDIQMTQSPSSLSAS |

| | | |
|---|---|---|
| ID Number | Text Description | Biological Sequence |
| | | VGDRVTITCRASQDVSTAVAWYQQKPGKAPKLLIYSASFLYS GVPSRFSGSGSGTDFTLTISSLQPEDFATYYCQQYLYHPATFG QGTKVEIKGILGFVFTL |
| SEQ ID NO: 611 | exemplary cell-targeting molecule 324 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPEVQLVESGGGLVQPGGSLRLSCAASGFTFSDSWI HWVRQAPGKGLEWVAWISPYGGSTYYADSVKGRFTISADTS KNTAYLQMNSLRAEDTAVYYCARRHWPGGFDYWGQGTLVT VSSGGGGSGGGGSGGGGSGGGGSGGGGSDIQMTQSPSSLSAS VGDRVTITCRASQDVSTAVAWYQQKPGKAPKLLIYSASFLYS GVPSRFSGSGSGTDFTLTISSLQPEDFATYYCQQYLYHPATFG QGTKVEIKGILGFVFTL |
| SEQ ID NO: 612 | exemplary cell-targeting molecule 325 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCRASQGISSWLA WYQQKPEKAPKSLIYAASSLQSGVPSRFSGSGSGTDFTLTISSL QPEDFATYYCQQYNSYPYTFGQGTKLEIKGGGGSQVQLVQSG AEVKKPGASVKVSCKASGYTFTSYDVHWVRQAPGQRLEWM GWLHADTGITKFSQKFQGRVTITRDTSASTAYMELSSLRSEDT AVYYCARERIQLWFDYWGQGTLVTVSSNLVPMVATV |
| SEQ ID NO: 613 | exemplary cell-targeting molecule 326 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVFFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSNLVPMVATV |
| SEQ ID NO: 614 | exemplary cell-targeting molecule 327 | QVQLQQPGAELVKPGASVKMSCKTSGYTFTSYNVHWVKQTP GQGLEWIGAIYPGNGDTSFNQKFKGKATLTADKSSSTVYMQL SSLTSEDSAVYYCARSNYYGSSYVWFFDVWGAGTTVTVSSGS TSGSGKPGSGEGSQIVLSQSPTILSASPGEKVTMTCRASSSVSY MDWYQQKPGSSPKPWIYATSNLASGVPARFSGSGSGTSYSLTI SRVEAEDAATYYCQQWISNPPTFGAGTKLELKEFPKPSTPPGS SGGAPGILGFVFTLKEFTLDFSTAKTYVDSLNVIRSAIGTPLQTI SSGGTSLLMIDSGIGDNLFAVDILGFDFTLGRFNNLRLIVERNN LYVTGFVNRTNNAFYRFADFSHVTFPGTTAVTLSADSSYTTL QRVAGISRTGMQINRHSLTTSYLALMSHSGTSLTQSVARAML RFVTVTAEALRFRQIQRGFRTTLDDLSGASYVMTAEDVDLTL NWGRLSSVLPDYHGQDSVRVGRISFGSINAILGSVALILNSHH HASAVAA |
| SEQ ID NO: 615 | exemplary cell-targeting molecule 328 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFFKPSTP PGSSGGAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNAFYRFADFSHVTFPGTTAVTLSADSSY TTLQRVAGISRTGMQINRHSLTTSYLALMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAA |

| | | |
|---|---|---|
| Sequence Listing | | |
| ID Number | Text Description | Biological Sequence |
| SEQ ID NO: 616 | exemplary cell-targeting molecule 329 | MDIQMTQSPSSLSASVGDRVTITCRASQDVNTAVAWYQQKP GKAPKLLIYSASFLYSGVPSRFSGSRSGTDFTLTISSLQPEDFAT YYCQQHYTTPPTFGQGTKVEIKRTGSTSGSGKPGSGEGSEVQL VESGGGLVQPGGSLRLSCAASGFNIKDTYIHWVRQAPGKGLE WVARIYPTNGYTRYADSVKGRFTISADTSKNTAYLQMNSLRA EDTAVYYCSRWGGDGFYAMDVWGQGTLVTVSSEFPKPSTPP GSSGGAPGILGFVFTLKEFTLDFSTAKTYVDSLNVIRSAIGTPL QTISSGGTSLLMIDSGIGDNLFAVDILGFDFTLGRFNNLRLIVER NNLYVTGFVNRTNNAFYRFADFSHVTFPGTTAVTLSADSSYT TLQRVAGISRTGMQINRHSLTTSYLALMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAAKDEL |
| SEQ ID NO: 617 | exemplary cell-targeting molecule 330 | MDIQMTQSPSSLSASVGDRVTITCRASQDVNTAVAWYQQKP GKAPKLLIYSASFLYSGVPSRFSGSRSGTDFTLTISSLQPEDFAT YYCQQHYTTPPTFGQGTKVEIKRTGSTSGSGKPGSGEGSEVQL VESGGGLVQPGGSLRLSCAASGFNIKDTYIHWVRQAPGKGLE WVARIYPTNGYTRYADSVKGRFTISADTSKNTAYLQMNSLRA EDTAVYYCSRWGGDGFYAMDVWGQGTLVTVSSEFPKPSTPP GSSGGAPGILGFVFTLKEFTLDFSTAKTYVDSLNVIRSAIGTPL QTISSGGTSLLMIDSGIGDNLFAVDILGFDFTLGRFNNLRLIVER NNLYVTGFVNRTNNAFYRFADFSHVTFPGTTAVTLSADSSYT TLQRVAGISRTGMQINRHSLTTSYLALMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAAKDEL |
| SEQ ID NO: 618 | exemplary cell-targeting molecule 331 | MDIELTQSPSSFSVSLGDRVTITCKASEDIYNRLAWYQQKPGN APRLLISGATSLETGVPSRFSGSGSGKDYTLSITSLQTEDVATY YCQQYWSTPTFGGGTKLEIKGSTSGSGKPGSGEGSKVQLQES GPSLVQPSQRLSITCTVSGFSLISYGVHWVRQSPGKGLEWLGV IWRGGSTDYNAAFMSRLSITKDNSKSQVFFKMNSLQADDTAI YFCAKTLITTGYAMDYWGQGTTVTVSSEFPKPSTPPGSSGGAP GILGFVFTLKEFTLDFSTAKTYVDSLNVIRSAIGTPLQTISSGGT SLLMIDSGIGDNLFAVDILGFDFTLGRFNNLRLIVERNNLYVTG FVNRTNNAFYRFADFSHVTFPGTTAVTLSADSSYTTLQRVAGI SRTGMQINRHSLTTSYLALMSHSGTSLTQSVARAMLRFVTVT AEALRFRQIQRGFRTTLDDLSGASYVNTAEDVDLTLNWGRLS SVLPDYHQDSVRVGRISFGSINAILGSVALILNSHHHASAVA AKDEL |
| SEQ ID NO: 619 | exemplary cell-targeting molecule 332 | MDIELTQSPSSFSVSLGDRVTITCKASEDIYNRLAWYQQKPGN APRLLISGATSLETGVPSRESGSGSGKDYTLSITSLQTEDVATY YCQQYWSTPTFGGGTKLEIKGSTSGSGKPGSGEGSKVQLQES GPSLVQPSQRLSITCTVSGFSLISYGVHWVRQSPGKGLEWLGV IWRGGSTDYNAAFMSRLSITKDNSKSQVFFKMNSLQADDTAI YFCAKTLITTGYAMDYWGQGTTVTVSSEFPKPSTPPGSSGGAP GILGFVFTLKEFTLDFSTAKTYVDSLNVIRSAIGTPLQTISSGGT SLLMIDSGIGDNLFAVDILGFDFTLGRFNNLRLIVERNNLYVTG FVNRTNNAFYRFADFSHVTFPGTTAVTLSADSSYTTLQRVAGI SRTGMQINRHSLTTSYLALMSHSGTSLTQSVARAMLRFVTVT AEALRFRQIQRGFRTTLDDLSGASYVMTAEDVDLTLNWGRLS SVLPDYHGQDSVRVGRISFGSINAILGSVALILNSHHHASAVA AKDEL |
| SEQ ID NO: 620 | exemplary cell-targeting molecule 333 | MDIVNTQAAPSIPVTPGESVSISCRSSKSLLNSNGNTYLYWFL QRPGQSPQLLIYRMSNLASGVPDRFSGSGSGTAFTLRISRVEAE DVGVYYCMQHLEYPFTFGAGTKLELKGSTSGSGKPGSGEGS VQLQQSGPELIKPGASVKMSCKASGYTFTSYVMHWVKQKPG QGLEWIGYINPYNDGTKYNEKFKGKATLTSDKSSSTAYMELS SLTSEDSAVYYCARGTYYYGSRVFDYWGQGTTLTVSSAEFPK PSTPPGSSGGAPGILGFVFTLKEFTLDFSTAKTYVDSLNVIRSAI GTPLQTISSGGTSLLMIDSGIGDNLFAVDILGFDFTLGRFNNLR LIVERNNLYVTGFVNRTNNAFYRFADFSHVTFPGTTAVTLSA DSSYTTLQRVAGISRTGMQINRHSLTTSYLALMSHSGTSLTQS VARAMLRFVTVTAEALRFRQIQRGFRTTLDDLSGASYVMTAE DVDLTLNWGRLSSVLPDYHGQDSVRVGRISFGSINAILGSVAL ILNSHHHASAVAAKDEL |
| SEQ ID NO: 621 | exemplary cell-targeting molecule 334 | MDIVMTQAAPSIPVTPGESVSISCRSSKSLLNSNGNTYLYWFL QRPGQSPQLLIYRMSNLASGVPDRFSGSGSGTAFTLRISRVEAE DVGVYYCMQHLEYPFTFGAGTKLELKGSTSGSGKPGSGEGSE VQLQQSGPELIKPGASVKMSCKASGYTFTSYVMHWVKQKPG |

Sequence Listing

| ID Number | Text Description | Biological Sequence |
|---|---|---|
| | | QGLEWIGYINPYNDGTKYNEKFKGKATLTSDKSSSTAYMELS<br>SLTSEDSAVYYCARGTYYYGSRVFDYWGQGTTLTVSSAEFPK<br>PSTPPGSSGGAPGILGFVFTLKEFTLDFSTAKTYVDSLNVIRSAI<br>GTPLQTISSGGTSLLMIDSGIGDNLFAVDILGFDFTLGRFNNLR<br>LIVERNNLYVTGFVNRTNNAFYRFADFSHVTFPGTTAVTLSA<br>DSSYTTLQRVAGISRTGMQINRHSLTTSYLALMSHSGTSLTQS<br>VARAMLRFVTVTAEALRFRQIQRGFRTTLDDLSGASYVMTAE<br>DVDLTLNWGRLSSVLPDYHGQDSVRVGRISFGSINAILGSVAL<br>ILNSHHHASAVAAKDEL |
| SEQ ID NO: 622 | exemplary cell-targeting molecule 335 | MDIQLTQSPLSLPVTLGQPASISCRSSQSLVHRNGNTYLHWFQ<br>QRPGQSPRLLIYTVSNRFSGVPDRFSGSGSGTDFTLKISRVEAE<br>DVGVYFCSQSSHVPPTFGAGTRLEIKGSTSGSGKPGSGEGSTK<br>GQVQLQQSGSELKKPGASVKVSCKASGYTFTNYGVNWIKQA<br>PGQGLQWMGWINPNTGEPTFDDDFKGRFAFSLDTSVSTAYLQ<br>ISSLKADDTAVYFCSRSRGKNEAWFAYWGQGTLVTVSSEFPK<br>PSTPPGSSGGAPGILGFVFTLKEFTLDFSTAKTYVDSLNVIRSAI<br>GTPLQTISSGGTSLLMIDSGIGDNLFAVDILGFDFTLGRFNNLR<br>LIVERNNLYVTGFVNRTNNAFYRFADFSHVTFPGTTAVTLSA<br>DSSYTTLQRVAGISRTGMQINRHSLTTSYLALMSHSGTSLTQS<br>VARAMLRFVTVTAEALRFRQIQRGFRTTLDDLSGASYVMTAE<br>DVDLTLNWGRLSSVLPDYHGQDSVRVGRISFGSINAILGSVAL<br>ILNSHHHASAVAAKDEL |
| SEQ ID NO: 623 | exemplary cell-targeting molecule 336 | MDIQLTQSPLSLPVTLGQPASISCRSSQSLVHRNGNTYLHWFQ<br>QRPGQSPRLLIYTVSNRFSGVPDRFSGSGSGTDFTLKISRVEAE<br>DVGVYFCSQSSHVPPTFGAGTRLEIKGSTSGSGKPGSGEGSTK<br>GQVQLQQSGSELKKPGASVKVSCKASGYTFTNYGVNWIKQA<br>PGQGLQWMGWINPNTGEPTFDDDFKGRFAFSLDTSVSTAYLQ<br>ISSLKADDTAYYFCSRSRGKNEAWFAYWGQGTLVTVSSEFPK<br>PSTPPGSSGGAPGILGFVFTLKEFTLDFSTAKTYVDSLNVIRSAI<br>GTPLQTISSGGTSLLMIDSGIGDNLFAVDILGFDFTLGRFNNLR<br>LIVERNNLYVTGFVNRTNNAFYRFADFSHVTFPGTTAVTLSA<br>DSSYTTLQRVAGISRTGMQINRHSLTTSYLALMSHSGTSLTQS<br>VARAMLRFVTVTAEALRFRQIQRGFRTTLDDLSGASYVMTAE<br>DVDLTLNWGRLSSVLPDYHGQDSVRVGRISFGSINAILGSVAL<br>ILNSHHHASAVAAKDEL |
| SEQ ID NO: 624 | exemplary cell-targeting molecule 337 | MEVQLVESGGGLVQAGGSLRLSCAASGITFSINTMGWYRQAP<br>GKQRELVALISSIGDTYYADSVKGRFTISRDNAKNTVYLQMN<br>SLKPEDTAVYYCKRFRTAAQGTDYWGQGTQVTVSSAHHSED<br>PSSKAPKAPGILGFVFTLKEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNAFYRFADFSHVTFPGTTAVTLSADSSY<br>TTLQRVAGISRTGMQINRHSLTTSYLALMSHSGTSLTQSVARA<br>MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAAKDEL |
| SEQ ID NO: 625 | exemplary cell-targeting molecule 338 | MEVQLVESGGGLVQAGGSLRLSCAASGITFSINTMGWYRQAP<br>GKQRELVALISSIGDTYYADSVKGRFTISRDNAKNTVYLQMN<br>SLKPEDTAVYYCKRFRTAAQGTDYWGQGTQVTVSSEFPKPST<br>PPGSSGGAPGILGFVFTLKEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNAFYRFADFSHVTFPGTTAVTLSADSSY<br>TTLQRVAGISRTGMQINRHSLTTSYLALMSHSGTSLTQSVARA<br>MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAAKDEL |
| SEQ ID NO: 626 | exemplary cell-targeting molecule 339 | MEVQLVESGGGLVQAGGSLRLSCAASGITFSINTMGWYRQAP<br>GKQRELVALISSIGDTYYADSVKGRFTISRDNAKNTVYLQMN<br>SLKPEDTAVYYCKRFRTAAQGTDYWGQGTQVTVSSAHHSED<br>PSSKAPKAPGILGFVFTLGILGFVFTLKEFTLDFSTAKTYVDSL<br>NVIRSAIGTPLQTISSGGTSLLMIDSGIGDNLFAVDILGFDFTLG<br>RFNNLRLIVERNNLYVTGFVNRTNNAFYRFADFSHVTFPGTT<br>AVTLSADSSYTTLQRVAGISRTGMQINRHSLTTSYLALMSHSG<br>TSLTQSVARAMLRFVTVTAEALRFRQIQRGFRTTLDDLSGASY<br>VMTAEDVDLTLNWGRLSSVLPDYHGQDSVRVGRISFGSINAI<br>LGSVALILNSHHHASAVAAKDEL |
| SEQ ID NO: 627 | exemplary cell-targeting molecule 340 | MEVQLVESGGGLVQAGGSLRLSCAASGITFSINTMGWYRQAP<br>GKQRELVALISSIGDTYYADSVKGRFTISRDNAKNTVYLQMN<br>SLKPEDTAVYYCKRFRTAAQGTDYWGQGTQVTVSSEFPKPST |

| | | |
|---|---|---|
| ID Number | Text Description | Biological Sequence |
| | | PPGSSGGAPGILGFVFTLGILGFVFTLKEFTLDFSTAKTYVDSL<br>NVIRSAIGTPLQTISSGGTSLLMIDSGIGDNLFAVDILGFDFTLG<br>RFNNLRLIVERNNLYVTGFVNRTNNAFYRFADFSHVTFPGTT<br>AVTLSADSSYTTLQRVAGISRTGMQINRHSLTTSYLALMSHSG<br>TSLTQSVARAMLRFVTVTAEALRFRQIQRGFRTTLDDLSGASY<br>VMTAEDVDLTLNWGRLSSVLPDYHGQDSVRVGRISFGSINAI<br>LGSVALILNSHHASAVAAKDEL |
| SEQ ID NO: 628 | exemplary cell-targeting molecule 341 | MAPTSSSTKKTQLQLEHLLLDLQMILNGINNYKNPKLTRMLT<br>FKFYMPKKATELKHLQCLEEELKPLEEVLNLAQSKNFHLRPR<br>DLISNINVIVLELKGSETTFMCEYADETATIVEFLNRWITFCQSI<br>ISTLTEFPKPSTPPGSSGGAPGILGFVFTLKEFTLDFSTAKTYVD<br>SLNVIRSAIGTPLQTISSGGTSLLMIDSGIGDNLFAVDILGFDFT<br>LGRFNNLRLIVERNNLYVTGFVNRTNNAFYRFADFSHVTFPG<br>TTAVTLSADSSYTTLQRVAGISRTGMQINRHSLTTSYLALMSH<br>SGTSLTQSVARAMLRFVTVTAEALRFRQIQRGFRTTLDDLSGA<br>SYVMTAEDVDLTLNWGRLSSVLPDYHGQDSVRVGRISFGSIN<br>AILGSVALILNSHHASAVAAKDEL |
| SEQ ID NO: 629 | exemplary cell-targeting molecule 342 | MAPTSSSTKKTQLQLEHLLLDLQMILNGINNYKNPKLTRMLT<br>FKFYMPKKATELKHLQCLEEELKPLEEVLNLAQSKNFHLRPR<br>DLISNINVIVLELKGSETTFMCEYADETATIVEFLNRWITFCQSI<br>ISTLTEFPKPSTPPGSSGGAPGILGFVFTLKEFTLDFSTAKTYVD<br>SLNVIRSAIGTPLQTISSGGTSLLMIDSGIGDNLFAVDILGFDFT<br>LGRFNNLRLIVERNNLYVTGFVNRTNNAFYRFADFSHVTFPG<br>TTAVTLSADSSYTTLQRVAGISRTGMQINRHSLTTSYLALMSH<br>SGTSLTQSVARAMLRFVTVTAEALRFRQIQRGFRTTLDDLSGA<br>SYVMTAEDVDLTLNWGRLSSVLPDYHGQDSVRVGRISFGSIN<br>AILGSVALILNCHHASAVAAKDEL |
| SEQ ID NO: 630 | exemplary cell-targeting molecule 343 | MQVQLVQSGAELVKPGASVKMSCKASGYTFTSYNMHWVKQ<br>TPGQGLEWIGAIYPGNGDTSYNQKFKGKATLTADKSSSTAYM<br>QLSSLTSEDSAVYYCARAQLRPNYWYFDVWGAGTTVTVSSG<br>STSGSGKPGSGEGSDIVLSQSPAILSASPGEKVTMTCRASSSVS<br>YMHWYQQKPGSSPKPWIYATSNLASGVPARFSGSGSGTSYSL<br>TISRVEAEDAATYYCQQWISNPPTFGAGTKLELKEFPKPSTPP<br>GSSGGAPGILGFVFTLKEFTLDFSTAKTYVDSLNVIRSAIGTPL<br>QTISSGGTSLLMIDSGIGDNLFAVDILGFDFTLGRFNNLRLIVER<br>NNLYVTGFVNRTNNAFYRFADFSHVTFPGTTAVTLSADSSYT<br>TLQRVAGISRTGMQINRHSLTTSYLALMSHSGTSLTQSVARA<br>MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAA |
| SEQ ID NO: 631 | exemplary cell-targeting molecule 344 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS<br>VSYMDWYQQKPGSSPKPWIYATSNLASGVPARFSGSGSGTSY<br>SLTISRVEAEDAATYYCQQWISNPPTFGAGTKLELKEFPKPSTP<br>PGSSGGAPGILGFVFTLKEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNAFYRFADFSHVTFPGTTAVTLSADSSY<br>TTLQRVAGISRTGMQINRHSLTTSYLALMSHSGTSLTQSVARA<br>MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAA |
| SEQ ID NO: 632 | exemplary cell-targeting molecule 345 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS<br>VSYMDWYQQKPGSSPKPWIYATSNLASGVPARFSGSGSGTSY<br>SLTISRVEAEDAATYYCQQWISNPPTFGAGTKLELKEFPKPSTP<br>PGSSGGAPGILGFVFTLKEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNAFYRFADFSHVTFTGTTAVTLSADSSY<br>TTLQRVAGISRTGMQINRHSLTTSYLALMSHSGTSLTQSVARA<br>MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAA |

Sequence Listing

| ID Number | Text Description | Biological Sequence |
|---|---|---|
| SEQ ID NO: 633 | exemplary cell-targeting molecule 346 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNAFYRFADFSHVTFPGTTAVTLSADSSY TTLQRVAGISRTGMQINRHSLTTSYLALMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAA |
| SEQ ID NO: 634 | exemplary cell-targeting molecule 347 | MQVQLQQPGAELVKPGASVKMSCKASGYTFTSYNMHWVKQ TPGRGLEWIGAIYPGNGDTSYNQKFKGKATLTADKSSSTAYM QLSSLTSEDSAVYYCARSTYYGGDWYFNVWGAGTTVTVSAG STSGSGKPGSGEGSTKGQIVLSQSPAILSASPGEKVTMTCRASS SVSYIHWFQQKPGSSPKPWIYATSNLASGVPVRFSGSGSGTSY SLTISRVEAEDAATYYCQQWTSNPPTFGGGTKLEIKEFPKPSTP PGSSGGAPGILGFVFTLKEFTLDFSTAKTYVDSLNVIRSAIGTP LQTISSGGTSLLMIDSGIGDNLFAVDILGFDFTLGRFNNLRLIVE RNNLYVTGFVNRTNNAFYRFADFSHVTFPGTTAVTLSADSSY TTLQRVAGISRTGMQINRHSLTTSYLALMSHSGTSLTQSVARA MLRFVTVTAEALRFRQIQRGFRTTLDDLSGASYVMTAEDVDL TLNWGRLSSVLPDYHGQDSVRVGRISFGSINAILGSVALILNSH HHASAVAA |
| SEQ ID NO: 635 | exemplary cell-targeting molecule 348 | MEVQLVESGGGLVQPGRSLRLSCAASGFTFNDYAMHWVRQA PGKGLEWVSTISWNSGSIGYADSVKGRFTISRDNAKKSLYLQ MNSLRAEDTALYYCAKDIQYGNYYYGMDVWGQGTTVTVSS GSTSGSGKPGSGEGSEIVLTQSPATLSLSPGERATLSCRASQSV SSYLAWYQQKPGQAPRLLIYDASNRATGIPARFSGSGSGTDFT LTISSLEPEDFAVYYCQQRSNWPITFGQGTRLEIKEFPKPSTPPG SSGGAPGILGFVFTLKEFTLDFSTAKTYVDSLNVIRSAIGTPLQ TISSGGTSLLMIDSGIGDNLFAVDILGFDFTLGRFNNLRLIVERN NLYVTGFVNRTNNAFYRFADFSHVTFPGTTAVTLSADSSYTT LQRVAGISRTGMQINRHSLTISYLALMSHSGTSLTQSVARAM LRFVTVTAEALRFRQIQRGFRTTLDDLSGASYVMTAEDVDLT LNWGRLSSVLPDYHGQDSVRVGRISFGSINAILGSVALILNSH HHASAVAA |
| SEQ ID NO: 636 | exemplary cell-targeting molecule 349 | MEIVLTQSPATLSLSPGERATLSCRASQSVSSYLAWYQQKPGQ APRLLIYDASNRATGIPARFSGSGSGTDFTLTISSLEPEDFAVY YCQQRSNWPITFGQGTRLEIKGGGGSGGGGSGGGGSGGGGSG GGGSEVQLVESGGGINQPGRSLRLSCAASGFTFNDYAMHWV RQAPGKGLEWVSTISWNSGSIGYADSVKGRFTISRDNAKKSL YLQMNSLRAEDTALYYCAKDIQYGNYYYGMDVWGQGTTVT VSSEFPKPSTPPGSSGGAPGILGFVFTLKEFTLDFSTAKTYVDS LNVIRSAIGTPLQTISSGGTSLLMIDSGIGDNLFAVDILGFDFTL GRFNNLRLIVERNNLYVTGFVNRTNNAFYRFADFSHVTFPGT TAVTLSADSSYTTLQRVAGISRTGMQINRHSLTTSYLALMSHS GTSLTQSVARAMLRFVTVTAEALRFRQIQRGFRTTLDDLSGAS YVMTAEDVDLTLNWGRLSSVLPDYHGQDSVRVGRISFGSINA ILGSVALILNSHHASAVAA |
| SEQ ID NO: 637 | exemplary cell-targeting molecule 350 | MQIVLSQSPAILSASPGEKVTMTCRASSSVSYMHWYQQKPGS SPKPWIYAPSNLASGVPARFSGSGSGTSYSLTISRVEAEDAATY YCQQWSFNPPTFGAGTKLELKSGGGGSGGGGSGGGGSGGGG SGGGGSQAYLQQSGAELVRPGASVKMSCKASGYTFTSYNMH WVKQTPRQGLEWIGAIYPGNGDTSYNQKFKGKATLTVDKSSS TAYMQLSSLTSEDSAVYFCARVVYYSNSYWYFDVWGTGTTV TVSEFPKPSTPPGSSGGILGFVFTLGAPKEFTLDFSTAKTYVDS LNVIRSAIGTPLQTISSGGTSLLMIDSGIGDNLFAVDILGFDFTL GRFNNLRLIVERNNLYVTGFVNRTNNAFYRFADFSHVTFPGT TAVTLSADSSYTTLQRVAGISRTGMQINRHSLTTSYLALMSHS GTSLTQSVARAMLRFVTVTAEALRFRQIQRGFRTTLDDLSGAS YVMTAEDVDLTLNWGRLSSVLPDYHGQDSVRVGRISFGSINA ILGSVALILNSHHASAVAA |
| SEQ ID NO: 638 | exemplary cell-targeting molecule 351 | MQAYLQQSGAELVRPGASVKMSCKASGYTFTSYNMHWVKQ TPRQGLEWIGAIYPGNGDTSYNQKFKGKATLTVDKSSSTAYM QLSSLTSEDSAVYTCARVVYYSNSYWYFDVWGTGTTVTVSG STSGSGKPGSGEGSQIVLSQSPAILSASPGEKVTMTCRASSSVS |

| | | |
|---|---|---|
| | | YMHWYQQKPGSSPKPWIYAPSNLASGVPARFSGSGSGTSYSL<br>TISRVEAEDAATYYCQQWSFNPPTFGAGTKLELKSEFPKPSTP<br>PGSSGGAPGILGFVFTLKEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNAFYRFADFSHVTFPGTTAVTLSADSSY<br>TTLQRVAGISRTGMQINRHSLTTSYLALMSHSGTSLTQSVARA<br>MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAA |
| SEQ ID<br>NO: 639 | exemplary<br>cell-targeting<br>molecule 352 | ASVSDVPRDLEVVAATPTSLLISWCRQRCADSYRITYGETGGN<br>SPVQEFTVPGSWKTATISGLKPGVDYTITVYVVTHYYGWDRY<br>SHPISINYRTGSEFPKPSTPPGSSGGAPGILGFVFTLKEFTLDFST<br>AKTYVDSLNVIRSAIGTPLQTISSGGTSLLMIDSGIGDNLFAVDI<br>LGFDFTLGRFNNLRLIVERNNLYVTGFVNRTNNAFYRFADFS<br>HVTFPGTTAVTLSADSSYTTLQRVAGISRTGMQINRHSLTTSY<br>LALMSHSGTSLTQSVARAMLRFVTVTAEALRFRQIQRGFRTT<br>LDDLSGASYVMTAEDVDLTLNWGRLSSVLPDYHGQDSVRVG<br>RISFGSINAILGSVALILNSHHHASAVAANLVPMVATV |
| SEQ ID<br>NO: 640 | exemplary<br>cell-targeting<br>molecule 353 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS<br>VSYMDWYQQKPGSSPKPWIYATSNLASGVPARFSGSGSGTSY<br>SLTISRVEAEDAATYYCQQWISNPPTFGAGTKLELKEFPKPSTP<br>PGSSGGAPGILGFVFTLKEFTLDFSTAKTYVDSLNVIRSAIGTP<br>LQTISSGGTSLLMIDSGIGDNLFAVDILGFDFTLGRFNNLRLIVE<br>RNNLYVTGFVNRTNNAFYRFADFSHVTFPGTTAVTLSADSSY<br>TTLQRVAGISRTGMQINRHSLTTSYLALMSHSGTSLTQSVARA<br>MLRFVTVTAEALRFRQIQRGFRTTLDDLSGASYVMTAEDVDL<br>TLNWGRLSSVLPDYHGQDSVRVGRISFGSINAILGSVALILNSH<br>HHASAVAAKDEL |
| SEQ ID<br>NO: 641 | exemplary<br>cell-targeting<br>molecule 354 | MKEFTLDFSTAKTYVDSLNVIRSAIGTPLQTISSGGTSLLMIDS<br>GIGDNLFAVDILGFDFTLGRFNNLRLIVERNNLYVTGFVNRTN<br>NAFYRFADFSHVTFPGTTAVTLSADSSYTTLQRVAGISRTGMQ<br>INRHSLTTSYLALMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHHASAVAAEFPKPST<br>PPGSSGGAPGILGFVFTLMQVQLQQPGAELVKPGASVKMSCK<br>TSGYTFTSYNVHWVKQTPGQGLEWIGAIYPGNGDTSFNQKFK<br>GKATLTADKSSSTVYMQLSSLTSEDSAVYYCARSNYYGSSYV<br>WFFDVWGAGTTVTVSSGSTSGSGKPGSGEGSQIVLSQSPTILS<br>ASPGEKVTMTCRASSSVSYMDWYQQKPGSSPKPWIYATSNL<br>ASGVPARFSGSGSGTSYSLTISRVEAEDAATYYCQQWISNPPT<br>FGAGTKLELK |
| SEQ ID<br>NO: 642 | exemplary<br>cell-targeting<br>molecule 355 | MKEFTLDFSTAKTYVDSLNVIRSAIGTPLQTISSGGTSLLMIDS<br>GIGDNLFAVDILGFDFTLGRFNNLRLIVERNNLYVTGFVNRTN<br>NAFYRFADFSHVTFPGTTAVTLSADSSYTTLQRVAGISRTGMQ<br>INRHSLTTSYLALMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHHASAVAAEFPKPST<br>PPGSSGGAPGILGFVFTLDIELTQSPSSFSVSLGDRVTITCKASE<br>DIYNRLAWYQQKPGNAPRLLISGATSLETGVPSRFSGSGSGKD<br>YTLSITSLQTEDVATYYCQQYAVSTPTFGGGTKLEIKGSTSGSG<br>KPGSGEGSKVQLQESGPSLVQPSQRLSITCTVSGFSLISYGVH<br>WVRQSPGKGLEWLGVIWRGGSTDYNAAFMSRLSITKDNSKS<br>QVFFKMNSLQADDTAIYFCAKTLITTGYAMDYWGQGTTVTV<br>SS |
| SEQ ID<br>NO: 643 | exemplary<br>cell-targeting<br>molecule 356 | MKEFTLDFSTAKTYVDSLNVIRSAIGTPLQTISSGGTSLLMIDS<br>GIGDNLFAVDILGFDFTLGRFNNLRLIVERNNLYVTGFVNRTN<br>NAFYRFADFSHVTFPGTTAVTLSADSSYTTLQRVAGISRTGMQ<br>INRHSLTTSYLALMSHSGTSLTQSVARAMLRFVTVTAEALRFR<br>QIQRGFRTTLDDLSGASYVMTAEDVDLTLNWGRLSSVLPDYH<br>GQDSVRVGRISFGSINAILGSVALILNSHHHASAVAAEFPKPST<br>PPGSSGGAPGILGFVFTLDIELTQSPSSFSVSLGDRVTITCKASE<br>DIYNRLAWYQQKPGNAPRLLISGATSLETGVPSRFSGSGSGKD<br>YTLSITSLQTEDVATYYCQQYWSTPTFGGGTKLEIKGSTSGSG<br>KPGSGEGSKVQLQESGPSLVQPSQRLSITCTVSGFSLISYGVH<br>WVRQSPGKGLEWLGVIWRGGSTDYNAAFMSRLSITKDNSKS<br>QVFFKMNSLQADDTAIYFCAKTLITTGYAMDYWGQGTTVTV |

-continued

| | | Sequence Listing |
|---|---|---|
| ID Number | Text Description | Biological Sequence |
| | | SS |
| SEQ ID NO: 644 | exemplary cell-targeting molecule 357 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIQMTQSPSSLSASVGDRVTITCRAS QDVNTAVAWYQQKPGKAPKLLIYSASFLYSGVPSRFSGSRSG TDFTLTISSLQPEDFATYYCQQHYTTPPTFGQGTKVEIKRTGST SGSGKPGSGEGSEVQLVESGGGLVQPGGSLRLSCAASGFNIKD TYIHWVRQAPGKGLEWVARIYPTNGYTRYADSVKGRFTISAD TSKNTAYLQMNSLRAEDTAVYYCSRWGGDGFYAMDVWGQ GTLVTVSS |
| SEQ ID NO: 645 | exemplary cell-targeting molecule 358 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIQMTQSPSSLSASVGDRVTITCRAS QDVNTAVAWYQQKPGKAPKLLIYSASFLYSGVPSRFSGSRSG TDFTLTISSLQPEDFATYYCQQHYTTPPTFGQGTKVEIKRIGST SGSGKPGSGEGSEVQLVESGGGLVQPGGSLRLSCAASGFNIKD TYIHWVRQAPGKGLEWVARIYPTNGYTRYADSVKGRFTISAD TSKNTAYLQMNSLRAEDTAVYYCSRWGGDGFYAMDVWGQ GTLVTVSS |
| SEQ ID NO: 646 | exemplary cell-targeting molecule 339 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIVMTQAAPSIPVTPGESVSISCRSSK SLLNSNGNTYLYWFLQRPGQSPQLLIYRMSNLASGVPDRFSGS GSGTAFTLRISRVEAEDVGVYYCMQHLEYPFTFGAGTKLELK GSTSGSGKPGSGEGSEVQLQQSGPELIKPGASVKMSCKASGYT FTSYVMHWVKQKPGQGLEWIGYINPYNDGTKYNEKFKGKAT LTSDKSSSTAYMELSSLTSEDSAVYYCARGTYYYGSRVFDYW GQGTTLTVSS |
| SEQ ID NO: 647 | exemplary cell-targeting molecule 360 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIVMTQAAPSIPVTPGESVSISCRSSK SLLNSNGNTYLYWFLQRPGQSPQLLIYRMSNLASGVPDRFSGS GSGTAFTLRISRVEAEDVGVYYCMQHLEYPFTFGAGTKLELK GSTSGSGKPGSGEGSEVQLQQSGPELIKPGASVKMSCKASGYT FTSYVMHWVKQKPGQGLEWIGYINPYNDGTKYNEKFKGKAT LTSDKSSSTAYMELSSLTSEDSAVYYCARGTYYYGSRVFDYW GQGTTLTVSS |
| SEQ ID NO: 648 | exemplary cell-targeting molecule 361 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIQLTQSPLSLPVTLGQPASISCRSSQ SLVHRNGNTYLHWFQQRPGQSPRLLIYTVSNRFSGVPDRFSGS GSGTDFTLKISRVEAEDVGVYFCSQSSHVPPTFGAGTRLEIKGS TSGSGKPGSGEGSTKGQVQLQQSGSELKKPGASVKVSCKASG YTFTNYGVNWIKQAPGQGLQWMGWINPNTGEPTFDDDFKGR FAFSLDTSVSTAYLQISSLKADDTAVYFCSRSRGKNEAWFAY WGQGTLVTVSS |

| Sequence Listing | | |
|---|---|---|
| ID Number | Text Description | Biological Sequence |
| SEQ ID NO: 649 | exemplary cell-targeting molecule 362 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIQLTQSPLSLPVTLGQPASISCRSSQ SLVHRNGNTYLHWFQQRPGQSPRLLIYTVSNRFSGVPDRFSGS GSGTDFTLKISRVEAEDVGVYFCSQSSHVPPTFGAGTRLEIKGS TSGSGKPGSGEGSTKGQVQLQQSGSELKKPGASVKVSCKASG YTFTNYGVNWIKQAPGQGLQWMGWINPNTGEPTFDDDFKGR FAFSLDTSVSTAYLQISSLKADDTAVYFCSRSRGKNEAWFAY WGQGTLVTVSS |
| SEQ ID NO: 650 | exemplary cell-targeting molecule 363 | MKEFTLDFSTAKTYVDSLNVIRSAIGTPLQTISSGGTSLLMIDS GIGDNLFAVDILGTDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAAHHSED PSSKAPKAPGILGFVFTLEVQLVESGGGLVQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |
| SEQ ID NO: 651 | exemplary cell-targeting molecule 364 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLEVQLVESGGGLVQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |
| SEQ ID NO: 652 | exemplary cell-targeting molecule 365 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLITSYLALMSHSGTSLIQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAAHHSED PSSKAPKAPGILGFVFTLEVQLVESGGGLVQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |
| SEQ ID NO: 653 | exemplary cell-targeting molecule 366 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRLSFGSINAILGSVALILNSHHASAVAAEFPKPST PPGSSGGAPGILGFVFTLEVQLVESGGGLVQAGGSLRLSCAAS GITFSINTMGWYRQAPGKQRELVALISSIGDTYYADSVKGRFT ISRDNAKNTVYLQMNSLKPEDTAVYYCKRFRTAAQGTDYWG QGTQVTVSS |
| SEQ ID NO: 654 | exemplary cell-targeting molecule 367 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIVLTQSPASLAVSLGQRATISCRAT ESVEYYGTSLVQWYQQKPGQPPKLLIYAASSVDSGVPARFSG SGSGTDFSLTIHPVEEDDIAMYFCQQSRRVPYTFGGGTKLEIK GGGGSEVQLQQSGPELVKPGASVKMSCKASGYTFTSYVMHW VKQKPGQGLEWIGYVNPFNDGTKYNEMFKGKATLTSDKSSS TAYMELSSLTSEDSAVYYCARQAWGYPWGQGTLVPVSA |

Sequence Listing

| ID Number | Text Description | Biological Sequence |
|---|---|---|
| SEQ ID NO: 655 | exemplary cell-targeting molecule 368 | MKEFTLDFSTAKTYVDSLNVIRSAIGTPLQTISSGGTSLLMIDS GIGDNLFAVDILGFDFTLGRFNNLRLIVERNNLYVTGFVNRTN NAFYRFADFSHVTFPGTTAVTLSADSSYTTLQRVAGISRTGMQ INRHSLTTSYLALMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPGILGFVFTLDIVLTQSPASLAVSLGQRATISCRAT ESVEYYGTSLVQWYQQKPGQPPKLLIYAASSVDSGVPARFSG SGSGTDFSLTIHPVEEDDIAMYFCQQSRRVPYTFGGGTKLEIK GGGGSEVQLQQSGPELVKPGASVKMSCKASGYTFTSYVMHW VKQKPGQGLEWIGYVNPFNDGTKYNEMFKGKATLTSDKSSS TAYMELSSLTSEDSAVYYCARQAWGYPWGQGTLVTVSA |
| SEQ ID NO: 656 | exemplary cell-targeting molecule 369 | KEFTLDFSTAKTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQI NRHSLTTSYLDLMSHSGTSLTQSVARAMLRFVTVTAEALRFR QIQRGFRTTLDDLSGASYVMTAEDVDLTLNWGRLSSVLPDYH GQDSVRVGRISFGSINAILGSVALILNSHHASAVAAEFPKPST PPGSSGGAPDIVLTQSPASLAVSLGQRATISCRATESVEYYGTS LVQWYQQKPGQPPKLLIYAASSVDSGVPARFSGSGSGTDFSLT IHPVEEDDIAMYFCQQSRRVPYTFGGGTKLEIKGGGGSEVQLQ QSGPELVKPGASVKMSCKASGYTFTSYVMHWVKQKPGQGLE WIGYVNPFNDGTKYNFMFKGKATLTSDKSSSTAYMELSSLTS EDSAVYYCARQAWGYPWGQGTLVTVSANLVPMVATV |
| SEQ ID NO: 657 | exemplary cell-targeting molecule 370 | VTEHDTLLYKEFTLDFSTAKTYVDSLNVIRSAIGTPLQTISSGG TSLLMIDSGSGDNLFAVDVRGIDPEEGRFNNLRLIVERNNLYV TGFVNRTNNVFYRFADFSHVTFPGTTAVTLSGDSSYTTLQRV AGISRTGMQINRHSLTTSYLDLMSHSGTSLTQSVARAMLRFVT VTAEALRERQIQRGFRTTLDDLSGRSYVMTAEDVDLTLNWGR LSSVLPDYHGQDSVRVGRISFGSINAILGSVALILNCHHASAV AAEFPKPSTPPGSSGGAPDIQMTQSPSSLSASVGDRVTITCKAS EDIYNRLTWYQQKPGKAPKLLISGATSLETGVPSRFSGSGSGT DFTFTISSLQPEDIATYYCQQYWSNPYTFGQGTKVEIKGGGGS QVQLQESGPGLVRPSQTLSLTCTVSGFSLTSYGVHWVRQPPG RGLEWIGVMWRGGSTDYNAAFMSRLNITKDNSKNQVSLRLS SVTAADTAVYYCAKSMITTGFVMDSWGQGSLVTVSS |
| SEQ ID NO: 658 | exemplary cell-targeting molecule 371 | GLDRNSGNYKEFTLDFSTAKTYVDSLNVIRSAIGTPLQTISSGG TSLLMIDSGSGDNLFAVDVRGIDPEEGRFNNLRLIVERNNLYV TGFVNRTNNVFYRFADFSHVTFPGTTAVTLSGDSSYTTLQRV AGISRTGMQINRHSLTTSYLDLMSHSGTSLTQSVARAMLRFVT VTAEALRFRQIQRGFRTTLDDLSGRSYVMTAEDVDLTLNWGR LSSVLPDYHGQDSVRVGRISFGSINAILGSVALILNCHHASAV AAEFPKPSTPPGSSGGAPDIQMTQSPSSLSASVGDRVTITCKAS EDIYNRLTWYQQKPGKAPKLLISGATSLETGVPSRFSGSGSGT DFTFTISSLQPEDIATYYCQQYWSNPYTFGQGTKVEIKGGGGS QVQLQESGPGLVRPSQTLSLTCTVSGFSLTSYGVHWVRQPPG RGLEWIGVMWRGGSTDYNAAFMSRLNITKDNSKNQVSLRLS SVTAADTAVYYCAKSMITTGFVMDSWGQGSLVTVSS |
| SEQ ID NO: 659 | exemplary cell-targeting molecule 372 | GVMTRGRLKEFTLDFSTAKTYVDSLNVIRSAIGTPLQTISSGGT SLLMIDSGSGDNLFAVDVRGIDPEEGRFNNLRLIVERNNLYVT GFVNRTNNVFYRFADFSHVTFPGTTAVTLSGDSSYTTLQRVA GISRTGMQINRHSLTTSYLDLMSHSGTSLTQSVARAMLRFVTV TAEALRFRQIQRGFRTTLDDLSGRSYVMTAEDVDLTLNWGRL SSVLPDYHGQDSVRVGRISFGSINAILGSVALILNCHHASAV AAEFPKPSTPPGSSGGAPDIQMTQSPSSLSASVGDRVTITCKAS EDIYNRLTWYQQKPGKAPKLLISGATSLETGVPSRFSGSGSGT DFTFTISSLQPEDIATYYCQQYWSNPYTFGQGTKVEIKGGGGS QVQLQESGPGLVRPSQTLSLTCTVSGFSLTSYGVHWVRQPPG RGLEWIGVMWRGGSTDYNAAFMSRLNITKDNSKNQVSLRLS SVTAADTAVYYCAKSMITTGFVMDSWGQGSLVTVSS |
| SEQ ID NO: 660 | exemplary cell-targeting molecule 373 | VYALPLKMLKEFTLDFSTAKTYVDSLNVIRSAIGTPLQTISSGG TSLLMIDSGSGDNLFAVDVRGIDPEEGRFNNLRLIVERNNLYV TGFVNRTNNVFYRFADFSHVTFPGTTAVTLSGDSSYTTLQRV AGISRTGMQINRHSLTTSYLDLMSHSGTSLTQSVARAMLRFVT VTAEALRFRQIQRGFRTILDDLSGRSYVMTAEDVDLTLNWGR LSSVLPDYHGQDSVRVGRISFGSINAILGSVALILNCHHASAV AAEFPKPSTPPGSSGGAPDIQMTQSPSSLSASVGDRVTITCKAS EDIYNRLTWYQQKPGKAPKLLISGATSLETGVPSRFSGSGSGT DFTFTISSLQPEDIATYYCQQYWSNPYTFGQGTKVEIKGGGGS |

| | | |
|---|---|---|
| ID Number | Text Description | Biological Sequence |
| | | QVQLQESGPGLVRPSQTLSLTCTVSGFSLTSYGVHWVRQPPG<br>RGLEWIGVMWRGGSTDYNAAFMSRLNITKDNSKNQVSLRLS<br>SVTAADTAVYYCAKSMITTGFVMDSWGQGSLVTVSS |
| SEQ ID NO: 661 | exemplary cell-targeting molecule 374 | NLVPMVATVKEFTLDFSTAKTYVDSLNVIRSAIGTPLQTISSGG<br>TSLLMIDSGSGDNLFAVDVRGIDPEEGRFNNLRLIVERNNLYV<br>TGFVNRTNNVFYRFADFSHVTFPGTTAVTLSGDSSYTLLQRV<br>AGISRTGMQINRHSLTTSYLDLMSHSGTSLTQSVARAMLRFVT<br>VTAEALRERQIQRGFRTTLDDLSGRSYVMTAEDVDLTLNWGR<br>LSSVLPDYHGQDSVRVGRISFGSINAILGSVALILNCHHHASAV<br>AAEFPKPSTPPGSSGGAPDIQMTQSPSSLSASVGDRVTITCKAS<br>EDIYNRLTWYQQKPGKAPKLLISGATSLETGVPSRFSGSGSGT<br>DFTFTISSLQPEDIATYYCQQYWSNPYTFGQGTKVEIKGSTSGS<br>GKPGSGEGSTKGQVQLQESGPGLVRPSQTLSLTCTVSGFSLTS<br>YGVHWVRQPPGRGLEWIGVMWRGGSTDYNAAFMSRLNITK<br>DNSKNQVSLRLSSVTAADTAVYWAKSMITTGFVMDSWGQG<br>SLVTVSS |
| SEQ ID NO: 662 | exemplary cell-targeting molecule 375 | GILGFVFTLKEFTLDFSTAKTYVDSLNVIRSAIGTPLQTISSGGT<br>SLLMIDSGSGDNLFAVDVRGIDPEEGRFNNLRLIVERNNLYVT<br>GFVNRTNNVFYRFADFSHVTFPGTTAVTLSGDSSYTTLQRVA<br>GISRTGMQINRHSLTTSYLDLMSHSGTSLTQSVARAMLRFVTV<br>TAEALRFRQIQRGFRTTLDDLSGRSYVMTAEDVDLTLNWGRL<br>SSVLPDYHGQDSVRVGRISFGSINAILGSVALILNCHHHASAV<br>AAEFPKPSTPPGSSGGAPDIQMTQSPSSLSASVGDRVTITCKAS<br>EDIYNRLTWYQQKPGKAPKLLISGATSLETGVPSRFSGSGSGT<br>DFTFTISSLQPEDIATYYCQQYWSNPYTFGQGTKVEIKGSTSGS<br>GKPGSGEGSTKGQVQLQESGPGLVRPSQTLSLTCTVSGFSLTS<br>YGVHWVRQPPGRGLEWIGVMWRGGSTDYNAAFMSRLNITK<br>DNSKNQVSLRLSSVTAADTAVYYCAKSMITTGFVMDSWGQG<br>SLVTVS |
| SEQ ID NO: 663 | exemplary cell-targeting molecule 376 | DIQMTQSPSSLSASVGDRVTIIVRASQDVNTAVAWYQQKPGK<br>APKLLIYSASFLYSGVPSRFSGSRSGTDFTLTISSLQPEDFATYY<br>CQQHYTTPPTFGQGTKVEIKRTGSTSGSGKPGSGEGSEVQLVE<br>SGGGLVQPGGSLRLSCAASGFNIKDTYIHWVRQAPGKGLEWV<br>ARIYPNGYTRYADSVKGRFTISADTSKNTAYLQMNSLRAED<br>TAVYYCSRWGGDGFYAMDVWGQGTLVTVSSEFPKPSTPPGS<br>SGGAPGILGFVFTLKEFTLDFSTAKTYVDSLNVIRSAIGTPLQTI<br>SSGGTSLLMIDSGSGDNLFAVDVRGIDPEEGRFNNLRLIVERN<br>NLYVTGFVNRTNNVFYRFADFSHVTFPGTTAVTLSGDSSYTT<br>LQRVAGISRTGMQINRHSLTTSYLDLMSHSGTSLTQSVARAM<br>LRFVTVTAEALRFRQIQRGFRTTLDDLSGRSYVMTAEDVDLT<br>LNWGRLSSVLPDYHGQDSVRVGRISFGSINAILGSVALILNCH<br>HHASAVAA |
| SEQ ID NO: 664 | exemplary cell-targeting molecule 377 | QVQLQQPGAELVKPGASVKMSCKTSGYTFTSYNVHWVKQTP<br>GQGLEWIGAIYPGNGDTSFNQKFKGKATLTADKSSSTVYMQL<br>SSLTSEDSAVYYCARSNYYGSSYVWFFDVWGAGTTVTVSSGS<br>TSGSGKPGSGEGSQIVLSQSPTILSASPGEKVTMTCRASSSVSY<br>MDWYQQKPGSSPKPWIYATSNLASGVPARFSGSGSGTSYSLTI<br>SRVEAEDANTYYCQQWISNPPTFGAGTKLELKEFPKPSTPPGS<br>SGGAPGILGFVFTLKEFTLDFSTAKTYVDSLNVIRSAIGTPLQTI<br>SSGGTSLLMIDSGSGDNLFAVDVRGIDPEEGRFNNLRLIVERN<br>NLYVTGFVNRTNNVFYRFADFSHVTFPGTTAVTLSGDSSYTT<br>LQRVAGISRTGMQINRHSLTTSYLDLMSHSGTSLTQSVARAM<br>LRFVTVTAEALRFRQIQRGFRTTLDDLSGRSYVMTAEDVDLT<br>LNWGRLSSVLPDYHGQDSVRVGRISFGSINAILGSVALILNCH<br>HHASAVAA |
| SEQ ID NO: 665 | exemplary cell-targeting molecule 378 | KEFTLDFSTAKTYVDSLNVIRSAIGTPLQTISSGGTSLLMIDSGS<br>GDNLFAVDVRGIDPEEGRFNNLRLIVERNNLYVTGFVNRTNN<br>VFYRFADFSHVTFPGTTAVTLSGDSSYTTLQRVAGISRTGMQI<br>NRHSLTTSYLDLMSHSGTSLTQSVARAMLRFVTVTAEALRFR<br>QIQRGFRTTLDDLSGRSYVMTAEDVDLTLNWGRLSSVLPDYH<br>GQDSVRVGRISFGSINAILGSVALILNCHHHASAVAAEFPKPST<br>PPGSSGGAPDIQMTQSPSSLSASVGDRVTITCKASEDIYNRLT<br>WYQQKPGKAPKLLISGATSLETGVPSRFSGSGSGTDFTFTISSL<br>QPEDIATYYCQQYWSNPYTFGQGTKVEIKGGGGSQVQLQESG<br>PGLVRPSQTLSLTCTVSGFSLTSYGVHWVRQPPGRGLEWIGV<br>MWRGGSTDYNAAFMSRLNITKDNSKNQVSLRLSSVTAADTA<br>VYYCAKSMITTGFVMDSWGQGSLVTVSSVTEHDTLLY |

| | | |
|---|---|---|
| SEQ ID NO: 666 | exemplary cell-targeting molecule 379 | KEFTLDFSTAKTYVDSLNVIRSAIGTPLQTISSGGTSLLMIDSGS GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSINAILGSVALILNCHHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSNLVPMVATV |
| SEQ ID NO: 667 | exemplary cell-targeting molecule 380 | KEFTLDFSTAKTYVDSLNVIRSAIGTPLQTISSGGTSLLMIDSGS GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSINAILGSVALILNCHHHASAVAAEFPKPST PPGSSGGAPDIQMTQSPSSLSASVGDRVIITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSQYDPVAALF |
| SEQ ID NO: 668 | exemplary cell-targeting molecule 381 | KEFTLDFSTAKTYVDSLNVIRSAIGTPLQTISSGGTSLLMIDSGS GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSINAILGSVALILNCHHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSCLGGLLTMV |
| SEQ ID NO: 669 | exemplary cell-targeting molecule 382 | KEFTLDFSTAKTYVDSLNVIRSAIGTPLQTISSGGTSLLMIDSGS GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSINAILGSVALILNCHHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSILRGSVAHK |
| SEQ ID NO: 670 | exemplary cell-targeting molecule 383 | KEFTLDFSTAKTYVDSLNVIRSAIGTPLQTISSGGTSLLMIDSGS GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTAEAIRFR QIQRGFRTTLDDLSGRSYVMTAEDVDLTLNWGRLSSVLPDYH GQDSVRVGRISFGSINAILGSVALILNCHHHASAVAAEFPKPST PPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGSTSGSGKPGSGE GSTKGQVQLQESGPGLVRPSQTLSLTCTVSGFSLTSYGVHWV RQPPGRGLEWIGVMWRGGSTDYNAAFMSRLNITKDNSKNQV SLRLSSVTAADTAVYYCAKSMITTGFVMDSWGQGSLVTVSSN LVPMVATV |
| SEQ ID NO: 671 | exemplary cell-targeting molecule 384 | KEPTLDFSTAKTYVDSLNVIRSAIGTPLQTISSGGTSLLMIDSGS GDNLFAVDVRGIDPEEGRFNNLRLIVERNNLYNTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSINAILGSVALILNCHHHASAVAAEFPKPST PPGSSGGAPDIQMTQSPSSLSASVGDRVTITCRASQDVNTAVA WYQQKPGKAPKLLIYSASFLYSGVPSRFSGSRSGTDFTLTISSL |

| | | |
|---|---|---|
| | | QPEDFATYYCQQHYTTPPTFGQGTKVEIKGGGGSEVQLVESG<br>GGLVQPGGSLRLSCAASGFNIKDTYIHWVRQAPGKGLEWVA<br>RIYPTNGYTRYADSVKGRFTISADTSKNTAYLQMNSLRAEDT<br>AVYYCSRWGGDGFYAMDYWGQGTLVTVSSNLVPMVATV |
| SEQ ID<br>NO: 672 | exemplary<br>cell-targeting<br>molecule 385 | KEFTLDFSTAKTYVDSLNVIRSAIGTPLQTISSGGTSLLMIDSGS<br>GDNLFAVDVRGIDPEEGRFNNLRLIVERNNLYVTGFVNRTNN<br>VFYRFADFSHVTFPGTTAVTLSGDSSYTTLQRVAGISRTGMQI<br>NRHSLTTSYLDLMSHSGTSLTQSVARAMLRFVTVTAEALRFR<br>QIQRGFRTTLDDLSGRSYVMTAEDVDLTLNWGRLSSVLPDYH<br>GQDSVRVGRISFGSINAILGSVALILNCHHHASAVAAEFPKPST<br>PPGSSGGAPEVQLVESGGGLVQPGGSLRLSCAASGFTFSDSWI<br>HWVRQAPGKGLEWVAWISPYGGSTYYADSVKGRFTISADTS<br>KNTAYLQMNSLRAEDTAVYYCARRHWPGGFDYWGQGTLVT<br>VSSGGGGSGGGGSGGGGSGGGGSGGGGSDIQMTQSPSSLSAS<br>VGDRVTITCRASQDVSTAVAWYQQKPGKAPKLLIYSASFLYS<br>GVPSRFSGSGSGTDFTLTISSLQPEDFATYYCQQYLYHPATFG<br>QGTKVEIKGILGFVFTL |
| SEQ ID<br>NO: 673 | exemplary<br>cell-targeting<br>molecule 386 | KEFTLDFSTAKTYVDSTNVIRSAIGTPLQTISSGGTSLLMIDSGS<br>GDNLFAVDVRGIDPEEGRFNNLRLIVERNNLYVTGFVNRTNN<br>VFYRFADFSHVTFPGTTAVTLSGDSSYTTLQRVAGISRTGMQI<br>NRHSLTTSYLDLMSHSGTSLTQSVARAMLRFVTVTAEALRFR<br>QIQRGFRTTLDDLSGRSYVMTAEDVDLTLNWGRLSSVLPDYH<br>GQDSVRVGRISFGSINAILGSVALILNCHHHASAVAAEFPKPST<br>PPGSSGGAPDIQMTQSPSSLSASVGDRVTITCRASQGISSWLA<br>WYQQKPEKAPKSLIYAASSLQSGVPSRFSGSGSGTDFTLTISSL<br>QPEDFATYYCQQYNSYPYTFGQGTKLEIKGGGGSQVQLVQSG<br>AEVKKPGASVKVSCKASGYTFTSYDVHWVRQAPGQRLEWM<br>GWLHADTGITKFSQKFQGRVTITRDTSASTAYMELSSLRSEDT<br>AVYYCARERIQLWFDYWGQGTLVTVSSNLVPMVATV |
| SEQ ID<br>NO: 674 | exemplary<br>cell-targeting<br>molecule 387 | KEFTLDFSTAKTYVDSLNVIRSAIGTPLQTISSGGTSLLMIDSGS<br>GDNLFAVDVRGIDPEEGRFNNLRLIVERNNLYVTGFVNRTNN<br>VFYRFADFSHVTFPGTTAVTLSGDSSYTTLQRVAGISRTGMQI<br>NRHSLTTSYLDLMSHSGTSLTQSVARAMLRFVTVTAEALRFR<br>QIQRGFRTTLDDLSGRSYVMTAEDVDLTLNWGRLSSVLPDYH<br>GQDSVRVGRISFGSINAILGSVALILNCHHHASAVAAEFPKPST<br>PPGSSGGAPDIQMTQSPSSLSASVGDRVTITCKASEDIYNRLT<br>WYQQKPGKAPKLLISGATSLETGVPSRFSGSGSGTDFTFTISSL<br>QPEDIATYYCQQYWSNPYTFGQGTKVEIKGGGGSQVQLQESG<br>PGLVRPSQTLSLTCTVSGFSLTSYGVHWVRQPPGRGLEWIGV<br>MWRGGSTDYNAAFMSRLNITKDNSKNQVSLRLSSVTAADTA<br>VYYCAKSMITTGFVMDSWGQGSLVTVSSNLVPMVATV |
| SEQ ID<br>NO: 675 | exemplary<br>cell-targeting<br>molecule 388 | KEFTLDFSTAKTYVDSLNVIRSAIGTPLQTISSGGTSLLMIDSGS<br>GDNLFAVDVRGIDPEEGRFNNLRLIVERNNLYVTGFVNRTNN<br>VFYRFADFSHVTFPGTTAVTLSGDSSYTTLQRVAGISRTGMQI<br>NRHSLTTSYLDLMSHSGTSLTQSVARAMLRFVTVTAEALRFR<br>QIQRGFRTTLDDLSGRSYVMTAEDVDLTLNWGRLSSVLPDYH<br>GQDSVRVGRISFGSINAILGSVALILNCHHHASAVAAEFPKPST<br>PPGSSGGAPQVQLQQPGAELVKPGASVKMSCKTSGYTFTSYN<br>VHWVKQTPGQGLEWIGAIYPGNGDTSFNQKFKGKATLTADK<br>SSSTVYMQLSSLTSEDSAVYYCARSNYYGSSYVWFFDVWGA<br>GTTVTVSSGSTSGSGKPGSGEGSQIVLSQSPTILSASPGEKVTM<br>TCRASSSVSYMDWYQQKPGSSPKPWIYATSNLASGVPARFSG<br>SGSGTSYSLTISRVEAEDAATYYCQQWISNPPTFGAGTKLELK<br>NLVPMVATV |
| SEQ ID<br>NO: 676 | exemplary<br>cell-targeting<br>molecule 389 | KEFTLDFSTAKTYVDSLNVIRSAIGTPLQTISSGGTSLLMIDSGS<br>GDNLFAVDVRGIDPEEGRFNNLRLIVERNNLYVTGFVNRTNN<br>VFYRFADFSHVTFPGTTAVTLSGDSSYTTLQRVAGISRTGMQI<br>NRHSLTTSYLDLMSHSGTSLTQSVARAMLRFVTVTAEALRFR<br>QIQRGFRTTLDDLSGRSYVMTAEDVDLTLNWGRLSSVLPDYH<br>GQDSVRVGRISFGSINAILGSVALILNCHHHASAVAAEFPKPST<br>PPGSSGGAPQVQLVQSGAELVKPGASVKMSCKASGYTFTSYN<br>MHWVKQTPGQGLEWIGAIYPGNGDTSYNQKFKGKATLTADK<br>SSSTAYMQLSSLTSEDSAVYYCARAQLRPNYWYFDVWGAGT<br>TVTVSSGGGGSDIVLSQSPAILSASPGEKVTMTCRASSSVSYM<br>HWYQQKPGSSPKPWIYATSNLASGVPARFSGSGSGTSYSLTIS<br>RVEAEDAATYYCQQWISNPPTFGAGTKLELKNLVPMVATV |

| ID Number | Text Description | Biological Sequence |
|---|---|---|
| SEQ ID NO: 677 | exemplary cell-targeting molecule 390 | KEFTLDFSTAKTYVDSLNVIRSAIGTPLQTISSGGTSLLMIDSGS GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSINAILGSVALILNCHHASAVAAEFPKPST PPGSSGGAPQVQLQQPGAELVKPGASVKMSCKASGYTFTSYN MHWVKQTPGRGLEWIGAIYPGNGDTSYNQKFKGKATLTADK SSSTAYMQLSSLTSEDSAVYYCARSTYYGGDWYFNVWGAGT TVTVSAGSTSGSGKPGSGEGSTKGQIVLSQSPAILSASPGEKVT MTCRASSSVSYIHWFQQKPGSSPKPWIYATSNLASGVPVRFSG SGSGTSYSLTISRVEAEDAATYYCQQWTSNPPTFGGGTKLEIK NLVPMVATV |
| SEQ ID NO: 678 | exemplary cell-targeting molecule 391 | KEFTLDFSTAKTYVDSLNVIRSAIGTPLQTISSGGTSLLMIDSGS GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSINAILGSVALILNCHHASAVAAEFPKPST PPGSSGGAPEVQLVESGGGLVQAGGSLRLSCAASGITFSINTM GWYRQAPGKQRELVALISSIGDTYYADSVKGRFTISRDNAKN TVYLQMNSLKPEDTAVYYCKRFRTAAQGTDYWGQGTQVTV SSAHHSEDNLVPMVATV |
| SEQ ID NO: 679 | exemplary cell-targeting molecule 392 | KEFTLDFSTAKTYVDSLNVIRSAIGTPLQTISSGGTSLLMIDSGS GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSINAILGSVALILNCHHASAVAAEFPKPST PPGSSGGAPDIELTQSPSSFSVSLGDRVTITCKASEDIYNRLAW YQQKPGNAPRLLISGATSLETGVPSRFSGSGSGKDYTLSITSLQ TEDVATYYCQQYWSTPTFGGGTKLEIKGSTSGSGKPGSGEGS KVQLQESGPSLVQPSQRLSITCTVSGFSLISYGVHWVRQSPGK GLEWLGVIWRGGSTDYNAAFMSRLSITKDNSKSQVFFKMNSL QADDTAIYFCAKTLITTGYAMDYWGQGTTVTVSSNLVPMVA TV |
| SEQ ID NO: 680 | exemplary cell-targeting molecule 393 | KEFTLDFSTAKTYVDSLNVIRSAIGTPLQTISSGGTSLLMIDSGS GDNLFAVDVRGIDPEEGRFNNLRLIVERNNLYVTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSINAILGSVALILNCHHASAVAAHHSED PSSKAPKAPEVQLVESGGGLVQAGGSLRLSCAASGITFSINTM GWYRQAPGKQRELVALISSIGDTYYADSVKGRFTISRDNAKN TVYLQMNSLKPEDTAVYYCKRFRTAAQGTDYWGQGTQVTV SSNLVPMVATV |
| SEQ ID NO: 681 | exemplary cell-targeting molecule 394 | KEFTLDFSTAKTYVDSLNVIRSAIGTPLQTISSGGTSLLMIDSGS GDNLFAVDVRGIDPEEGRFNNLRLIVERNNLYNTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR QIQRGFRTTLDDLSGRSYVMTAEDVDLTLNWGRLSSVLPDYH GQDSVRVGRISFGSINAILGSVALILNCHHASAVAAEFPKPST PPGSSGGAPASVSDVPRDLEVVAATPTSLLISWCRQRCADSYR ITYGETGGNSPVQEFTVPGSWKTATISGLKPGVDYTITVYVVT HYYGWDRYSHPISINYRTGSNLVPMVATV |
| SEQ ID NO: 682 | exemplary cell-targeting molecule 395 | ASVSDVPRDLEVVAATPTSLLISWCRQRCADSYRITYGETGGN SPVQEFTVPGSWKTATISGLKPGVDYTITVYVVTHYYGWDRY SHPISINYRTGSEFPKPSTPPGSSGGAPKEFTLDFSTAKTYVDSL NVIRSAIGTPLQTISSGGTSLLMIDSGSGDNLFAVDVRGIDPEE GRFNNLRLIVERNNLYVTGFVNRTNNVFYRFADFSHVTFPGT TAVTLSGDSSYTTLQRVAGISRTGMQINRHSLTTSYLDLMSHS GTSLTQSVARAMLRFVTVTADALRFRQIQRGFRTTLDDLSGR SYVMTAEDVDLTLNWGRLSSVLPDYHGQDSVRVGRISFGSIN AILGSVALILNSHHHASAVAAANLVPMVATV |
| SEQ ID NO: 683 | exemplary cell-targeting molecule 396 | KEFTLDFSTAKTYVDSLNVIRSAIGTPLQTISSGGTSLLMIDSGS GDNLFAVDVRGIDPEEGRFNNLRLIVERNNLYNTGFVNRTNN VFYRFADFSHVTFPGTTAVTLSGDSSYTTLQRVAGISRTGMQI NRHSLTTSYLDLMSHSGTSLTQSVARAMLRFVTVTAEALRFR |

| | | |
|---|---|---|
| ID Number | Text Description | Biological Sequence |
| | | QIQRGFRTTLDDLSGRSYVMTAEDVDLTLNWGRLSSVLPDYH GQDSVRVGRISFGSINAILGSVALILNCHHASAVAAEFPKPST PPGSSGGAPDIVLTQSPASLAVSLGQRATISCRATESVEYYGTS LVQWYQQKPGQPPKLLIYAASSVDSGVPARFSGSGSGTDFSLT IHPVEEDDIAMYFCQQSRRVPYTFGGGTKLEIKGGGGSEVQLQ QSGPELVKPGASVKMSCKASGYTFTSYVMHWVKQKPGQGLE WIGYVNPFNDGTKYNEMFKGKATLTSDKSSSTAYMELSSLTS EDSAVYYCARQAWGYPWGQGTLVTVSANLVPMVATV |
| SEQ ID NO: 684 | exemplary cell-targeting molecule 397 | NLVPMVATVKEFTLDFSTAKTYVDSLNVIRSAIGTPLQTISSGG TSLLMIDSGSGDNLFAVDVRGIDPEEGRFNNLRLIVERNNLYV TGFVNRTNNVFYRFADFSHVTFPGTTAVTLSGDSSYTTLQRV AGISRTGMQINRHSLTTSYLDLMSHSGTSLTQSVARAMLRFVT VTAEALRFRQIQRGFRTTLDDLSGRSYVMTAEDVDLTLNWGR LSSVLPDYHGQDSVRVGRISFGSINAILGSVALILNCHHASAV AAGGGGSGGDIQMTQSPSSLSASVGDRVTITCKASEDIYNRLT WYQQKPGKAPKLLISGATSLETGVPSRFSGSGSGTDFTFTISSL QPEDIATYYCQQYWSNPYTFGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSS |
| SEQ ID NO: 685 | exemplary cell-targeting molecule 398 | NLVPMVATVKEFTLDFSTAKTYVDSLNVIRSAIGTPLQTISSGG TSLLMIDSGSGDNLFAVDVRGIDPEEGRFNNLRLIVERNNLYV TGFVNRTNNVFYRFADFSHVTFPGTTAVTLSGDSSYTTLQRV AGISRTGMQINRHSLTTSYLDLMSHSGTSLTQSVARAMLRFVT VTAEALRFRQIQRGFRTTLDDLSGRSYVMTAEDVDLTLNWGR LSSVLPDYHGQDSVRVGRISFGSINAILGSVALILNCHHASAV AAEFPKPSTPPGSSGGAPDIQMTQSPSSLSASVGDRVTITCKAS EDIYNRLTWYQQKPGKAPKLLISGATSLETGVPSRFSGSGSGT DFTFTISSLQPEDIATYYCQQYWSNPYTFGQGTKVEIKGSTSGS GKPGSGEGSTKGQVQLQESGPGLVRPSQTLSLTCTVSGFSLTS YGVHWVRQPPGRGLEWIGVMWRGGSTDYNAAFMSRLNITK DNSKNQVSLRLSSVTAADTAVYYCAKSMITTGFVMDSWGQG SLVTVSS |
| SEQ ID NO: 686 | exemplary cell-targeting molecule 399 | NLVPMVATVKEFTLDFSTAKTYVDSLNVIRSAIGTPLQTISSGG TSLLMIDSGSGDNLFAVDVRGIDPEEGRFNNLRLIVERNNLYV TGFVNRTNNVFYRFADFSHVTFPGTTAVTLSGDSSYTTLQRV AGISRTGMQINRHSLTTSYLDLMSHSGTSLTQSVARAMLRFVT VTAEALRFRQIQRGFRTTLDDLSGRSYVMTAEDVDLTLNWGR LSSVLPDYHGQDSVRVGRISFGSINAILGSVALILNCHHASAV AAEFPKPSTPPGSSGGAPDIQMTQSPSSLSASVGDRVTITCRAS QDVNTAVAWYQQKPGKAPKLLIYSASFLYSGVPSRFSGSRSG TDFTLTISSLQPEDFATYYCQQHYTTPPTFGQGTKVEIKGGGG SEVQLVESGGGLVQPGGSLRLSCAASGFNIKDTYIHWVRQAP GKGLEWVARIYPTNGYTRYADSVKGRFTISADTSKNTAYLQ MNSLRAEDTAVYYCSRWGGDGFYAMDYWGQGTLVTVSS |
| SEQ ID NO: 687 | exemplary cell-targeting molecule 400 | GILGFVFTLKEFTLDFSTAKTYVDSLNVIRSAIGTPLQTISSGGT SLLMIDSGSGDNLFAVDVRGIDPEEGRFNNLRLIVERNNLYVT GFVNRTNNVFYRFADFSHVTFPGTTAVTLSGDSSYTTLQRVA GISRTGMQINRHSLTTSYLDLMSHSGTSLTQSVARAMLRFVTV TAEALRFRQIQRGFRTTLDDLSGRSYVMTAEDVDLTLNWGRL SSVLPDYHGQDSVRVGRISFGSINAILGSVALILNCHHASAV AAEFPKPSTPPGSSGGAPEVQLVESGGGLVQPGGSLRLSCAAS GFTFSDSWIHWVRQAPGKGLEWVAWISPYGGSTYYADSVKG RFTISADTSKNTAYLQMNSLRAEDTAVYYCARRHWPGGFDY WGQGTLVTVSSGGGGSGGGGSGGGGSGGGGSGGGGSDIQMT QSPSSLSASVGDRVTITCRASQDVSTAVAWYQQKPGKAPKLLI YSASFLYSGVPSRFSGSGSGTDFTLTISSLQPEDFATYYCQQYL YHPATFGQGTKVEIK |
| SEQ ID NO: 688 | exemplary cell-targeting molecule 401 | NLVPMVATVKEFTLDFSTAKTYVDSLNVIRSAIGTPLQTISSGG TSLLMIDSGSGDNLFAVDVRGIDPEEGRFNNLRLIVERNNLYV TGFVNRTNNVFYRFADFSHVTFPGTTAVTLSGDSSYTTLQRV AGISRTGMQINRHSLTTSYLDLMSHSGTSLTQSVARAMLRFVT VTAEALRFRQIQRGFRTTLDDLSGRSYVMTAEDVDLTLNWGR LSSVLPDYHGQDSVRVGRISFGSINAILGSVALILNCHHASAV AAGGGGSGGDIQMTQSPSSLSASVGDRVTITCRASQGISSWLA WYQQKPEKAPKSLIYAASSLQSGVPSRFSGSGSGTDFTLTISSL QPEDFATYYCQQYNSYPYTFGQGTKLEIKGGGGSQVQLVQSG |

| | | |
|---|---|---|
| ID Number | Text Description | Biological Sequence |
| | | AEVKKPGASVKVSCKASGYTFTSYDVHWVRQAPGQRLEWM GWLHADTGITKFSQKFQGRVTITRDTSASTAYMELSSLRSEDT AVYYCARERIQLWFDYWGQGTLVTVSS |
| SEQ ID NO: 689 | exemplary cell-targeting molecule 402 | NLVPMVATVKEFTLDFSTAKTYVDSLNVIRSAIGTPLQTISSGG TSLLMIDSGSGDNLFAVDVRGIDPEEGRFNNLRLIVERNNLYV TGFVNRTNNVFYRFADFSHYTFPGTTAVTLSGDSSYTTLQRV AGISRTGMQINRHSLTTSYLDLMSHSGTSLTQSVARAMLRFVT VTAEALRFRQIQRGFRTTLDDLSGRSYVMTAEDVDLTLNWGR LSSVLPDYHGQDSVRVGRISFGSINAILGSVALILNCHHHASAV AAEFPKPSTPPGSSGGAPDIQMTQSPSSLSASVGDRVTITCKAS EDIYNRLTWYQQKPGKAPKLLISGATSLETGVPSRFSGSGSGT DFTFTISSLQPEDIATYYCQQYWSNPYTFGQGTKVEIKGGGGS QVQLQESGPGLVRPSQTLSLTCTVSGFSLTSYGVHWVRQPPG RGLEWIGVMWRGGSTDYNAAFMSRLNITKDNSKNQVSLRLS SVTAADTAVYYCAKSMITTGFVMDSWGQGSLVTVSS |
| SEQ ID NO: 690 | exemplary cell-targeting molecule 403 | NLVPMVATVKEFTLDFSTAKTYVDSLNVIRSAIGTPLQTISSGG TSLLMIDSGSGDNLFAVDVRGIDPEEGRFNNLRLIVERNNLYV TGFVNRTNNVFYRFADFSHVTFPGTTAVTLSGDSSYTTLQRV AGISRTGMQINRHSLTTSYLDLMSHSGTSLTQSVARAMLRFVT VTAEALRFRQIQRGFRTTLDDLSGRSYVMTAEDVDLTLNWGR LSSVLPDYHGQDSVRVGRISFGSINAILGSVALILNCHHHASAV AAEFPKPSTPPGSSGGAPQVQLQQPGAELVKPGASVKMSCKT SGYTFTSYNVHWVKQTPGQGLEWIGAIYPGNGDTSFNQKFKG KATLTADKSSSTVYMQLSSLTSEDSAVYYCARSNYYGSSYV WFFDVWGAGTTVTVSSGSTSGSGKPGSGEGSQIVLSQSPTILS ASPGEKVTMTCRASSSVSYMDWYQQKPGSSPKPWIYATSNL ASGVPARFSGSGSGTSYSLTISRVEAEDAATYYCQQWISNPPT FGAGTKLELK |
| SEQ ID NO: 691 | exemplary cell-targeting molecule 404 | NLVPMVATVKEFTLDESTAKTYVDSLNVIRSAIGTPLQTISSGG TSLLMIDSGSGDNLFAVDVRGIDPEEGRFNNLRLIVERNNLYV TGFVNRTNNVFYRFADFSHVTFPGTTAVTLSGDSSYTTLQRV AGISRTGMQINRHSLTTSYLDLMSHSGTSLTQSVARAMLRFVT VTAEALRFRQIQRGFRTTLDDLSGRSYVMTAEDVDLTLNWGR LSSVLPDYHGQDSVRVGRISFGSINAILGSVALILNCHHHASAV AAGGGGSGGGQVQLVQSGAELVKPGASVKMSCKASGYTFTSY NMHWVKQTPGQGLEWIGAIYPGNGDTSYNQKFKGKATLTAD KSSSTAYMQLSSLTSEDSAVYYCARAQLRPNYWYFDVWGAG TTVTVSSGGGGSGGGGSGGGGSGGGGSGGGGSDIVLSQSPAI LSASPGEKVTMTCRASSSVSYMHWYQQKPGSSPKPWIYATSN LASGVPARFSGSGSGTSYSLTISRVEAEDAATYYCQQWISNPP TFGAGTKLELK |
| SEQ ID NO: 692 | exemplary cell-targeting molecule 405 | APTSSSTKKTQLQLEHLLLDLQMILNGINNYKNPKLTRMLTFK FYMPKKATELKHLQCLEEELKPLEEVLNLAQSKNFHLRPRDLI SNINVIVLELKGSETTFMCEYADETATIVEFLNRWITFCQSIIST LTEFPKPSTPPGSSGGAPNLVPMVATVKEFTLDFSTAKTYVDS LNVIRSAIGTPLQTISSGGTSLLMIDSGSGDNLFAVDVRGIDPEE GRFNNLRLIVERNNLYVTGFVNRTNNVFYRFADFSHVTFPGT TAVTLSGDSSYTTLQRVAGISRTGMQINRHSLTTSYLDLMSHS GTSLTQSVARAMLRFVTVTAEALRFRQIQRGFRTTLDDLSGRS YVMTAEDVDLTLNWGRLSSVLPDYHGQDSVRVGRISFGSINA ILGSVALILNSHHHASAVAA |
| SEQ ID NO: 693 | exemplary cell-targeting molecule 406 | GILGFVFTLKEFTLDFSTAKTYVDSLNVIRSAIGTPLQTISSGGT SLLMIDSGSGDNLFAVDVRGIDPEEGRFNNLRLIVERNNLYVT GFVNRTNNVFYRFADFSHVTFPGTTAVTLSGDSSYTTLQRVA GISRTGMQINRHSLTTSYLDLMSHSGTSLTQSVARAMLRFVTV TAEALRFRQIQRGFRTTLDDLSGRSYVMTAEDVDLTLNWGRL SSVLPDYHGQDSVRVGRISFGSINAILGSVALILNSHHHASAVA AEFPKPSTPPGSSGGAPAPTSSSTKKTQLQLEHLLLDLQMILNG INNYKNPKLTRMLTFKFYNTPKKATELKHLQCLEEELKPLEEV LNLAQSKNFHLRPRDLISNINVIVLELKGSETTFMCEYADETA TIVEFLNRWITFCQSIISTLT |
| SEQ ID NO: 694 | exemplary cell-targeting molecule 407 | MNLVPMVATVKEFTLDFSTAKTYVDSLNVIRSAIGTPLQTISS GGTSLLMIDSGSGDNLFAVDVRGIDPEEGRFNNLRLIVERNNL YVTGFVNRTNNVFYRFADFSHVTFPGTTAVTLSGDSSYTTLQ RVAGISRTGMQINRHSLTTSYLDLMSHSGTSLTQSVARAMLR FVTVTAEALRFRQIQRGFRTTLDDLSGRSYVMTAEDVDLTLN WGRLSSVLPDYHGQDSVRVGRISFGSINAILGSVALILNCHHH ASAVAAEFPKPSTPPGSSGGAPDIQMTQSPSSLSASVGDRVTIT |

| ID Number | Text Description | Biological Sequence |
|---|---|---|
| | | CKASEDIYNRLTWYQQKPGKAPKLLISGATSLETGVPSRFSGS<br>GSGTDFTFTISSLQPEDIATYYCQQYWSNPYTFGQGTKVEIKG<br>STSGSGKPGSGEGSTKGQVQLQESGPGLVRPSQTLSLTCTVSG<br>FSLTSYGVHWVRQPPGRGLEWIGVMWRGGSTDYNAAFMSRL<br>NTIKDNSKNQVSLRLSSVTAADTAVYYCAKSMITTGFVMDS<br>WGQGSLVTVSS |
| SEQ ID NO: 695 | exemplary cell-targeting molecule 408 | MNLVPMVATVKEFTLDFSTAKTYVDSLNVIRSAIGTPLQTISS<br>GGTSLLMIDSGSGDNLFAVDVRGIDPEEGRFNNLRLIVERNNL<br>YVTGFVNRTNNVFYRFADFSHVTFPGTTAVTLSGDSSYTTLQ<br>RVAGISRTGMQINRHSLTTSYLDLMSHSGTSLTQSVARAMLR<br>FVTVTAEALRFRQIQRGFRTTLDDLSGRSYVMTAEDVDLTLN<br>WGRLSSVLPDYHGQDSVRVGRISFGSINAILGSVALILNCHHH<br>ASAVAAEFPKPSTPPGSSGGAPDIQMTQSPSSLSASVGDRVTIT<br>CKASEDIYNRLTWYQQKPGKAPKLLISGATSLETGVPSRFSGS<br>GSGTDFTFTISSLQPEDIATYYCQQYWSNPYTFGQGTKVEIKG<br>STSGSGKPGSGEGSTKGQVQLQESGPGLVRPSQTLSLTCTVSG<br>FSLTSYGVHWVRQPPGRGLEWIGVMWRGGSTDYNAAFMSRL<br>NITKDNSKNQVSLRLSSVTAADTAVYYCAKSMITTGFVMDS<br>WGQGSLVTVSS |
| SEQ ID NO: 696 | exemplary cell-targeting molecule 409 | MKEFTLDFSTAKTYVDSLNVIRSAIGTPLQTISSGGTSLLMIDS<br>GSGDNLFAVDVRGIDPEEGRFNNLRLIVERNNLYVTGFVNRT<br>NNVFYRFADFSHVTFPGTTAVTLSGDSSYTTLQRVAGISRTGM<br>QINRHSLTTSYLDLMSHSGTSLTQSVARAMLRFVTVTAEALRF<br>RQIQRGFRTTLDDLSGRSYVMTAEDVDLTLNWGRLSSVLPDY<br>HGQDSVRVGRISFGSINAILGSVALILNCHHHASAVAAEFPKPS<br>TPPGSSGGAPDIQMTQSPSSLSASVGDRVTITCKASEDIYNRLT<br>WYQQKPGKAPKLLISGATSLETGVPSRFSGSGSGTDFTFTISSL<br>QPEDIATYYCQQYWSNPYTFGQGTKVEIKGSTSGSGKPGSGE<br>GSTKGQVQLQESGPGLVRPSQTLSLTCTVSGFSLTSYGVHWV<br>RQPPGRGLEWIGVMWRGGSTDYNAAFMSRLNITKDNSKNQV<br>SLRLSSVTAADTAVYYCAKSMITTGFVMDSWGQGSLVTVSSN<br>LVPMVATV |
| SEQ ID NO: 697 | exemplary cell-targeting molecule 410 | MKEFTLDFSTAKTYVDSLNVIRSAIGTPLQTISSGGTSLLMIDS<br>GSGDNLFAVDVRGIDPEEGRFNNLRLIVERNNLYVTGFVNRT<br>NNVFYRFADFSHVTFPGTTAVTLSGDSSYTTLQRVAGISRTGM<br>QINRHSLTTSYLDLMSHSGTSLTQSVARAMLRFVTVTAEALRF<br>RQIQRGFRTTLDDLSGRSYVMTAEDVDLTLNWGRLSSVLPDY<br>HGQDSVRVGRISFGSINAILGSVALILNCHHHASAVAAEFPKPS<br>TPPGSSGGAPDIQMTQSPSSLSASVGDRVTITCKASEDIYNRLT<br>WYQQKPGKAPKLLISGATSLETGVPSRFSGSGSGTDFTFTISSL<br>QPEDIATYYCQQYWSNPYTFGQGTKVEIKGSTSGSGKPGSGE<br>GSTKGQVQLQESGPGLVRPSQTLSLTCTVSGFSLTSYGVHWV<br>RQPPGRGLEWIGVMWRGGSTDNYNAAFMSRLNITKDNSKNQV<br>SLRLSSVTAADTAVYYCAKSMITTGFVMDSWGQGSLVTVSSN<br>LVPMVATV |
| SEQ ID NO: 698 | exemplary cell-targeting molecule 411 | MGILGFVFTLKEFTLDFSTAKTYVDSLNVIRSAIGTPLQTISSG<br>GTSLLMIDSGSGDNLFAVDVRGIDPEEGRFNNLRLIVERNNLY<br>VTGFVNRTNNVFYRFADFSHVTFPGTTAVTLSGDSSYTTLQR<br>VAGISRTGMQINRHSLTTSYLDLMSHSGTSLTQSVARAMLRF<br>VTVTAEALRFRQIQRGFRTTLDDLSGRSYVMTAEDVDLTLNW<br>GRLSSVLPDYHGQDSVRVGRISFGSINAILGSVALILNCHHHAS<br>AVAAEFPKPSTPPGSSGGAPDIQMTQSPSSLSASVGDRVTITCK<br>ASEDIYNRLTWYQQKPGKAPKLLISGATSLETGVPSRFSGSGS<br>GTDFTFTISSLQPEDIATYYCQQYWSNPYTFGQGTKVEIKGSTS<br>GSGKPGSGEGSTKGQVQLQESGPGLVRPSQTLSLTCTVSGFSL<br>TSYGVHWVRQPPGRGLEWIGVMWRGGSTDYNAAFMSRLNIT<br>KDNSKNQVSLRLSSVTAADTAVYYCAKSMITTGFVMDSWGQ<br>GSLVTVSS |
| SEQ ID NO: 699 | exemplary cell-targeting molecule 412 | MDIQMTSPSSLSASVGDRVTITCRASQDVNTAVAWYQQKP<br>GKAPKLLIYSASFLYSGVPSRFSGSRSGTDFTLTISSLQPEDFAT<br>YYCQQHYTTPPTFGQGTKVEIKRTGSTSGSGKPGSGEGSEVQL<br>VESGGGLVQPGGSLRLSCAASGFNIKDTYIHWVRQAPGKGLE<br>WVARIYPTNGYTRYADSVKGRFTISADTSKNTAYLQMNSLRA<br>EDTAVYYCSRWGGDGFYAMDVWGQGTLVTVSSEFPKPSTPP<br>GSSGGAPGILGFVFTLKEFTLDFSTAKTYVDSLNVIRSAIGTPL<br>QTISSGGTSLLMIDSGSGDNLFAVDVRGIDPEEGRFNNLRLIVE<br>RNNLYVTGFVNRTNNVFYRFADFSHVTFPGTTAVTLSGDSSY |

| | | |
|---|---|---|
| ID Number | Text Description | Biological Sequence |
| | | TTLQRVAGISRTGMQINRHSLTTSYLDLMSHSGTSLTQSVARA<br>MLRFVTVTAEALRFRQIQRGFRTTLDDLSGRSYVMTAEDVDL<br>TLNWGRLSSVLPDYHGQDSVRVGRISFGSINAILGSVALILNC<br>HHHASAVAA |
| SEQ ID NO: 700 | exemplary cell-targeting molecule 413 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS<br>VSYMDWYQQKPGSSPKPWIYATSNLASGVPARFSGSGSGTSY<br>SLTISRVEAEDAATYYCQQWISNPPTFGAGTKLELKEFPKPSTP<br>PGSSGGAPGILGFVFTLKEFTLDFSTAKTYVDSLNVIRSAIGTP<br>LQTISSGGTSLLMIDSGSGDNLFAVDVRGIDPEEGRFNNLRLIV<br>ERNNLYVTGFVNRTNNVFYRFADFSHVTFPGTTAVTLSGDSS<br>YTTLQRVAGISRTGMQINRHSLTTSYLDLMSHSGTSLTQSVAR<br>AMLRFVTVTAEALRFRQIQRGFRTTLDDLSGRSYVMTAEDVD<br>LTLNWGRLSSVLPDYHGQDSVRVGRISFGSINAILGSVALILNC<br>HHHASAVAA |
| SEQ ID NO: 701 | exemplary cell-targeting molecule 414 | MKEFTLDFSTAKTYVDSLNVIRSAIGTPLQTISSGGTSLLMIDS<br>GSGDNLFAVDVRGIDPEEGRFNNLRLIVERNNLYVTGFVNRT<br>NNVFYRFADFSHVTFPGTTAVTLSGDSSYTTLQRVAGISRTGM<br>QINRHSLTTSYLDLMSHSGTSLTQSVARAMLRFVTVTAEALRF<br>RQIQRGFRTTLDDLSGRSYVMTAEDVDLTLNWGRLSSVLPDY<br>HGQDSVRVGRISFGSINAILGSVALILNCHHHASAVAAEFPKPS<br>TPPGSSGGAPDIQMTQSPSSLSASVGDRVTITCRASQDVNTAV<br>AWYQQKPGKAPKLLIYSASFLYSGVPSRFSGSRSGTDFTLTISS<br>LQPEDFATYYCQQHYTTPPTFGQGTKVEIKGGGGSEVQLVES<br>GGGLVQPGGSLRLSCAASGFNIKDTYIHWVRQAPGKGLEWV<br>ARIYPTNGYTRYADSVKGRFTISADTSKNTAYLQMNSLRAED<br>TAVYYCSRWGGDGFYAMDYWGQGTLVTVSSNLVPMVATV |
| SEQ ID NO: 702 | exemplary cell-targeting molecule 415 | MKEFTLDFSTAKTYVDSLNVIRSAIGTPLQTISSGGTSLLMIDS<br>GSGDNLFAVDVRGIDPEEGRFNNLRLIVERNNLYVTGFVNRT<br>NNVFYRFADFSHVTFPGTTAVTLSGDSSYTTLQRVAGISRTGM<br>QINRHSLTTSYLDLMSHSGTSLTQSVARAMLRFVTVTAEALRF<br>RQIQRGFRTTLDDLSGRSYVMTAEDVDLTLNWGRLSSVLPDY<br>HGQDSVRVGRISFGSINAILGSVALILNCHHHASAVAAEFPKPS<br>TPPGSSGGAPEVQLVESGGGLVQPGGSLRLSCAASGFTFSDSW<br>IHWVRQAPGKGLEWVAWISPYGGSTYYADSVKGRFTISADTS<br>KNTAYLQMNSLRAEDTAVYYCARRHWPGGFDYWGQGTLVT<br>VSSGGGGSGGGGSGGGGSGGGGSGGGGSDIQMTQSPSSLSAS<br>VGDRVTITCRASQDVSTAVAWYQQKPGKAPKLLIYSASFLYS<br>GVPSRFSGSGSGTDFTLTISSLQPEDFATYYCQQYLYHPATFG<br>QGTKVEIKGILGFVFTL |
| SEQ ID NO: 703 | exemplary cell-targeting molecule 416 | MKEFTLDFSTAKTYVDSLNVIRSAIGTPLQTISSGGTSLLMIDS<br>GSGDNLFAVDVRGIDPEEGRFNNLRLIVERNNLYVTGFVNRT<br>NNVFYRFADFSHVTFPGTTAVTLSGDSSYTTLQRVAGISRTGM<br>QINRHSLTTSYLDLMSHSGTSLTQSVARAMLRFVTVTAEALRF<br>RQIQRGFRTTLDDLSGRSYVMTAEDVDLTLNWGRLSSVLPDY<br>HGQDSVRVGRISFGSINAILGSVALILNCHHHASAVAAEFPKPS<br>TPPGSSGGAPEVQLVESGGGLVQPGGSLRLSCAASGFTFSDSW<br>IHWVRQAPGKGLEWVAWISPYGGSTYYADSVKGRFTISADTS<br>KNTAYLQMNSLRAEDTAVYYCARRHWPGGFDYWGQGTLVT<br>VSSGGGGSGGGGSGGGGSGGGGSGGGGSDIQMTQSPSSLSAS<br>VGDRVTITCRASQDVSTAVAWYQQKPGKAPKLLIYSASFLYS<br>GVPSRFSGSGSGTDFTLTISSLQPEDFATYYCQQYLYHPATFG<br>QGTKVEIKGILGFVFTL |
| SEQ ID NO: 704 | exemplary cell-targeting molecule 417 | MKEFTLDFSTAKTYVDSLNVIRSAIGTPLQTISSGGTSLLMIDS<br>GSGDNLFAVDVRGIDPEEGRFNNLRLIVERNNLYVTGFVNRT<br>NNVFYRFADFSHVTFPGTTAVTLSGDSSYTTLQRVAGISRTGM<br>QINRHSLTTSYLDLMSHSGTSLTQSVARAMLRFVTVTAEALRF<br>RQIQRGFRTTLDDLSGRSYVMTAEDVDLTLNWGRLSSVLPDY<br>HGQDSVRVGRISFGSINAILGSVALILNCHHHASAVAAEFPKPS<br>TPPGSSGGAPDIQMTQSPSSLSASVGDRVTITCRASQGISSWLA<br>WYQQKPEKAPKSLIYAASSLQSGVPSRFSGSGSGTDFTLTISSL<br>QPEDFATYYCQQYNSYPYTFGQGTKLEIKGGGGSQVQLVQSG<br>AEVKKPGASVKVSCKASGYTFTSYDVHWVRQAPGQRLEWM<br>GWLHADTGITKFSQKFQGRVTITRDTSASTAYMELSSLRSEDT<br>AVYYCARERIQLWFDYWGQGTLVTVSSNLVPMVATV |

Sequence Listing

| ID Number | Text Description | Biological Sequence |
|---|---|---|
| SEQ ID NO: 705 | exemplary cell-targeting molecule 418 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPDIQMTQSPSSLSASVGDRVTITCKASEDIYNRLT WYQQKPGKAPKLLISGATSLETGVPSRFSGSGSGTDFTFTISSL QPEDIATYYCQQYWSNPYTTGQGTKVEIKGGGGSQVQLQESG PGLVRPSQTLSLTCTVSGFSLTSYGVHWVRQPPGRGLEWIGV MWRGGSTDYNAAFMSRLNITKDNSKNQVSLRLSSVTAADTA VYYCAKSMITTGFVMDSWGQGSLVTVSSNLVPMVATV |
| SEQ ID NO: 706 | exemplary cell-targeting molecule 419 | QVQLQQPGAELVKPGASVKMSCKTSGYTFTSYNVHWVKQTP GQGLEWIGAIYPGNGDTSFNQKFKGKATLTADKSSSTVYMQL SSLTSEDSAVYYCARSNYYGSSYVWFFDVWGAGTTVTVSSGS TSGSGKPGSGEGSQIVLSQSPTILSASPGEKVTMTCRASSSVSY MDWYQQKPGSSPKPWIYATSNLASGVPARFSGSGSGTSYSLTI SRVEAEDAATYYCQQWISNPPTFGAGTKLELKEFPKPSTPPGS SGGAPGILGFVFTLKEFTLDFSTAKTYVDSLNVIRSAIGTPLQTI SSGGTSLLMIDSGSGDNLFAVDVRGIDPEEGRFNNLRLIVERN NLYVTGFVNRTNNVFYRFADFSHVTFPGTTAVTLSGDSSYTT LQRVAGISRTGMQINRHSLTTSYLDLMSHSGTSLTQSVARAM LRFVTVTAEALRFRQIQRGFRTTLDDLSGRSYVMTAEDVDLT LNWGRLSSVLPDYHGQDSVRVGRISFGSINAILGSVALILNCH HHASAVAA |
| SEQ ID NO: 707 | exemplary cell-targeting molecule 420 | MQVQLQQPGAELVKPGASVKMSCKTSGYTFTSYNVHWVKQ TPGQGLEWIGAIYPGNGDTSFNQKFKGKATLTADKSSSTVYM QLSSLTSEDSAVYYCARSNYYGSSYVWFFDVWGAGTTVTVS SGSTSGSGKPGSGEGSQIVLSQSPTILSASPGEKVTMTCRASSS VSYMDWYQQKPGSSPKPWIYATSNLASGVPARFSGSGSGTSY SLTISRVEAEDAATYYCQQWISNPPTFGAGTKLELKEFPKPSTP PGSSGGAPGILGFVFTLKEFTLDFSTAKTYVDSLNVIRSAIGTP LQTISSGGTSLLMIDSGSGDNLFAVDVRGIDPEEGRFNNLRLIV ERNNLYVTGFVNRTNNVFYRFADFSHVTFPGTTAVTLSGDSS YTTLQRVAGISRTGMQINRHSLTTSYLDLMSHSGTSLTQSVAR AMLRFVTVTAEALRFRQIQRGFRTTLDDLSGRSYVMTAEDVD LTLNWGRLSSVLPDYHGQDSVRVGRISFGSINAILGSVALILNC HHASAVAA |
| SEQ ID NO: 708 | exemplary cell-targeting molecule 421 | MDIQMTQSPSSLSASVGDRVTITCRASQDVNTAVAWYQQKP GKAPKLLIYSASFLYSGVPSRFSGSRSGTDFTLTISSLQPEDFAT YYCQQHYTTPPTFGQGTKVEIKRTGSTSGSGKPGSEGSEVQL VESGGGLVQPGGSLRLSCAASGFNIKDTYIHWVRQAPGKGLE WVARIYPTNGYTRYADSVKGRFTISADTSKNTAYLQMNSLRA EDTAVYYCSRWGGDGFYAMDMGQGTLVTVSSEFPKPSTPP GSSSGGAPGILGFVFTLKEFTLDFSTAKTYVDSLNVIRSAIGTPL QTISSGGTSLLMIDSGSGDNLFAVDVRGIDPEEGRFNNLRLIVE RNNLYVTGFVNRTNNVFYRFADFSHVTFPGTTAVTLSGDSSY TTLQRVAGISRTGMQINRHSLTTSYLDLMSHSGTSLTQSVARA MLRFVTVTAEALRFRQIQRGFRTTLDDLSGRSYVMTAEDVDL TLNWGRLSSVLPDYHGQDSVRVGRISFGSINAILGSVALILNC HHASAVAAKDEL |
| SEQ ID NO: 709 | exemplary cell-targeting molecule 422 | MDIQMTQSPSSLSASVGDRVTITCRASQDVNTAVAWYQQKP GKAPKLLIYSASFLYSGVPSRFSGSRSGTDFTLTISSLQPEDFAT YYCQQHYTTPPTFGQGTKVEIKRTGSTSGSGKPGSEGSEVQL VESGGGLVQPGGSLRLSCAASGFNIKDTYIHWVRQAPGKGLE WVARIYPTNGYTRYADSVKGRFTISADTSKNTAYLQMNSLRA EDTAVYYCSRWGGDGFYAMDVWGQGTLVTVSSEFPKPSTPP GSSSGGAPGILGFVFTLKEFTLDFSTAKTYVDSLNVIRSAIGTPL QTISSGGTSLLMIDSGSGDNLFAVDVRGIDPEEGRFNNLRLIVE RNNLYVTGFVNRTNNVFYRFADFSHVTFPGTTAVTLSGDSSY TTLQRVAGISRTGMQINRHSLTTSYLDLMSHSGTSLTQSVARA MLRFVTVTAEALRFRQIQRGFRTTLDDLSGRSYVMTAEDVDL TLNWGRLSSVLPDYHGQDSVRVGRISFGSINAILGSVALILNC HHASAVAAKDEL |
| SEQ ID NO: 710 | exemplary cell-targeting molecule 423 | MDIELTQSPSSFSVSLGDRVTITCKASEDIYNRLAWYQQKPGN APRLLISGATSLETGVPSRFSGSGSGKDYTLSITSLQTEDVATY YCQQYWSTPTFGGGTKLEIKGSTSGSGKPGSEGSKVQLQES GPSLVQPSQRLSITCTVSGFSLISYGVHWVRQSPGKGLEWLGV IWRGGSTDYNAAFMSRLSITKDNSKSQVFFKMNSLQADDTAI |

-continued

| Sequence Listing | | |
|---|---|---|
| ID Number | Text Description | Biological Sequence |
| | | YFCAKTLITTGYAMDYWGQGTTVTVSSEFPKPSTPPGSSGGAP GILGFVFTLKEFTLDFSTAKTYVDSLNVIRSAIGTPLQTISSGGT SLLMIDSGSGDNLFAVDVRGIDPEEGRFNNLRLIVERNNLYVT GFVNRTNNVFYRFADFSHVTFPGTTAVTLSGDSSYTTLQRVA GISRTGMQINRHSLTTSYLDLMSHSGTSLTQSVARAMLRFVTV TAEALRFRQIQRGFRTTLDDLSGRSYVMTAEDVDLTLNWGRL SSVLPDYHGQDSVRVGRISFGSINAILGSVALILNCHHHASAV AAKDEL |
| SEQ ID NO: 711 | exemplary cell-targeting molecule 424 | MDIELTQSPSSFSVSLGDRVTITCKASEDIYNRLAWYQQKPGN APRLLISGATSLETGVPSRFSGSGSGKDYTLSITSLQTEDVATY YCQQYWSTPTFGGGTKLEIKGSTSGSGKPGSGEGSKVQLQES GPSLVQPSQRLSITCTVSGFSLISYGVHWVRQSPGKGLEWLGV IWRGGSTDYNAAFMSRLSITKDNSKSQVFFKMNSLQADDTAI YFCAKTLITTGYAMDYWGQGTTVTVSSEFPKPSTPPGSSGGAP GILGFVFTLKEFTLDFSTAKTYVDSLNVIRSAIGTPLQTISSGGT SLLMIDSGSGDNLFAVDVRGIDPEEGRFNNLRLIVERNNLYVT GFVNRTNNVFYRFADFSHVTFPGTTAVTLSGDSSYTTLQRVA GISRTGMQINRHSLTTSYLDLMSHSGTSLTQSVARAMLRFVTV TAEALRFRQIQRGFRTTLDDLSGRSYVMTAEDVDLTLNWGRL SSVLPDYHGQDSVRVGRISFGSINAILGSVALILNCHHHASAV AAKDEL |
| SEQ ID NO: 712 | exemplar cell-targeting molecule 425 | MDWMTQAAPSIPVTPGESVSISCRSSKSLLNSNGNTYLYWFL QRPGQSPQLLIYRMSNLASGVPDRFSGSGSGTAFTLRISRVEAE DVGVYYCMQHLEYPFTFGAGTKLELKGSTSGSGKPGSGEGSE VQLQQSGPELIKPGASVKMSCKASGYTFTSYVMHWVKQKPG QGLEWIGYINPYNDGTKYNEKFKGKATLTSDKSSSTAYMELS SLTSEDSAVYYCARGTYYYGSRVFDYWGQGTTLTVSSAEFPK PSTPPGSSGGAPGILGFVFTLKEFTLDFSTAKTYVDSLNVIRSAI GTPLQTISSGGTSLLMIDSGSGDNLFAVDVRGIDPEEGRFNNLR LIVERNNLYVTGFVNRTNNVFYRFADFSHVTFPGTTAVTLSG DSSYTTLQRVAGISRTGMQINRHSLTTSYLDLMSHSGTSLTQS VARAMLRFVTVTAEALRFRQIQRGFRTTLDDLSGRSYVMTAE DVDLTLNWGRLSSVLPDYHGQDSVRVGRISFGSINAILGSVAL ILNCHHHASAVAAKDEL |
| SEQ ID NO: 713 | exemplary cell-targeting molecule 426 | MDIVMTQAAPSIPVTPGESVSISCRSSKSLLNSNGNTYLYWFL QRPGQSPQLLIYRMSNLASGVPDRFSGSGSGTAFTLRISRVEAE DVGVYYCMQHLEYPFTFGAGTKLELKGSTSGSGKPGSGEGSE VQLQQSGPELIKPGASVKMSCKASGYTFTSYVMHWVKQKPG QGLEWIGYINPYNDGTKYNEKFKGKATLTSDKSSSTAYMELS SLTSEDSAVYYCARGTYYYGSRVFDYWGQGTTLTVSSAEFPK PSTPPGSSGGAPGILGFVFTLKEFTLDFSTAKTYVDSLNVIRSAI GTPLQTISSGGTSLLMIDSGSGDNLFAVDVRGIDPEEGRFNNLR LIVERNNLYVTGFVNRTNNVFYRFADFSHVTFPGTTAVTLSG DSSYTTLQRVAGISRIGMQINRHSLTTSYLDLMSHSGTSLTQS VARAMLRFVTVTAEALRFRQIQRGFRTTLDDLSGRSYVMTAE DVDLTLNWGRLSSVLPDYHGQDSVRVGRISFGSINAILGSVAL ILNCHHHASAVAAKDEL |
| SEQ ID NO: 714 | exemplary cell-targeting molecule 427 | MDIQLTQSPLSLPVTLGQPASISCRSSQSLVHRNGNTYLHWFQ QRPGQSPRLLIYTVSNRFSGVPDRFSGSGSGTDFTLKISRVEAE DVGVYFCSQSSHVPPTFGAGTRLEIKGSTSGSGKPGSGEGSTK GQVQLQQSGSELKKPGASVKVSCKASGYTFTNYGVNWIKQA PGQGLQWMGWINPNTGEPTFDDDFKGRFAFSLDTSVSTAYLQ ISSLKADDTAVYFCSRSRGKNEAWFAYWGQGTLVTVSSEFPK PSTPPGSSGGAPGILGFVFTLKEFTLDFSTAKTYVDSLNVIRSAI GTPLQTISSGGTSLLMIDSGSGDNLFAVDVRGIDPEEGRFNNLR LIVERNNLYVTGFVNRTNNVFYRFADFSHVTFPGTTAVTLSG DSSYTTLQRVAGISRTGMQINRHSLTTSYLDLMSHSGTSLTQS VARAMLRFVTVTAEALRFRQIQRGFRTTLDDLSGRSYVMTAE DVDLTLNWGRLSSVLPDYHGQDSVRVGRISFGSINAILGSVAL ILNCHHHASAVAAKDEL |
| SEQ ID NO: 715 | exemplary cell-targeting molecule 428 | MDIQLTQSPLSLPVTLGQPASISCRSSQSLVHRNGNTYLHWFQ QRPGQSPRLLIYTVSNRFSGVPDRFSGSGSGTDFTLKISRVEAE DVGVYFCSQSSHVPPTFGAGTRLEIKGSTSGSGKPGSGEGSTK GQVQLQQSGSELKKPGASVKVSCKASGYTFTNYGVNWIKQA PGQGLQWMGWINPNTGEPTFDDDFKGRFAFSLDTSVSTAYLQ ISSLKADDTAVYFCSRSRGKNEAWFAYWGQGTLVTVSSEFPK PSTPPGSSGGAPGILGFVFTLKEFTLDFSTAKTYVDSLNVIRSAI GTPLQTISSGGTSLLMIDSGSGDNLFAVDVRGIDPEEGRFNNLR LIVERNNLYVTGFVNRTNNVFYRFADFSHVTFPGTTAVTLSG |

| | | |
|---|---|---|
| ID Number | Text Description | Biological Sequence |
| | | DSSYTTLQRVAGISRTGMQINRHSLTTSYLDLMSHSGTSLTQS VARAMLRFVTVTEALRERQIQRGFRTTLDDLSGRSYVMTAE DVDLTLNWGRLSSVLPDYHGQDSVRVGRISFGSINAILGSVAL ILNCHHHASAVAAKDEL |
| SEQ ID NO: 716 | exemplary cell-targeting molecule 429 | MEVQLVESGGGLVQAGGSLRLSCAASGITFSINTMGWYRQAP GKQRELVALISSIGDTYYADSVKGRFTISRDNAKNTVYLQMN SLKPEDTAVYYCKRFRTAAQGTDYWGQGTQVTVSSAHHSED PSSKAPKAPGILGFVFTLKEFTLDFSTAKTYVDSLNVIRSAIGTP LQTISSGGTSLLMIDSGSGDNLFAVDVRGIDPEEGRFNNLRLIV ERNNLYVTGFVNRTNNVFYRFADFSHVTFPGTTAVTLSGDSS YTTLQRVAGISRTGMQINRHSLTTSYLDLMSHSGTSLTQSVAR AMLRFVTVTAEALRFRQIQRGFRTTLDDLSGRSYVMTAEDVD LTLNWGRLSSVLPDYHGQDSVRVGRISFGSINAILGSVALILNC HHASAVAAKDEL |
| SEQ ID NO: 717 | exemplary cell-targeting molecule 430 | MEVQLVESGGGLVQAGGSLRLSCAASGITFSINTMGWYRQAP GKQRELVALISSIGDTYYADSVKGRFTISRDNAKNTVYLQMN SLKPEDTAVYYCKRFRTAAQGTDYWGQGTQVTVSSEFPKPST PPGSSGGAPGILGFVFTLKEFTLDFSTAKTYVDSLNVIRSAIGTP LQTISSGGTSLLMIDSGSGDNLFAVDVRGIDPEEGRFNNLRLIV ERNNLYVTGFVNRTNNVFYRFADFSHVTFPGTTAVTLSGDSS YTTLQRVAGISRTGMQINRHSLTTSYLDLMSHSGTSLTQSVAR AMLRFVTVTAEALRFRQIQRGFRTTLDDLSGRSYVMTAEDVD LTLNWGRLSSVLPDYHGQDSVRVGRISFGSINAILGSVALILNC HHASAVAAKDEL |
| SEQ ID NO: 718 | exemplary cell-targeting molecule 431 | MEVQLVESGGGLVQAGGSLRLSCAASGITFSINTMGWYRQAP GKQRELVALISSIGDTYYADSVKGRFTISRDNAKNTVYLQMN SLKPEDTAVYYCKRFRTAAQGTDYWGQGTQVTVSSAHHSED PSSKAPKAPGILGFVFTLGILGFVFTLKEFTLDFSTAKTYVDSL NVIRSAIGTPLQTISSGGTSLLMIDSGSGDNLFAVDVRGIDPEE GRFNNLRLIVERNNLYVTGFVNRTNNVFYRFADFSHVTFPGT TAVTLSGDSSYTTLQRVAGISRTGMQINRHSLTTSYLDLMSHS GTSLTQSVARAMLRFVTVTAEALRFRQIQRGFRTTLDDLSGRS YVMTAEDVDLTLNWGRLSSVLPDYHGQDSVRVGRISFGSTNA ILGSVAIALNCHHASAVAAKDEL |
| SEQ ID NO: 719 | exemplary cell-targeting molecule 432 | MEVQLVESGGGLVQAGGSLRLSCAASGITFSINTMGWYRQAP GKQRELVALISSIGDTYYADSVKGRFTISRDNAKNTVYLQMN SLKPEDTAVYYCKRFRTAAQGTDYWGQGTQVTVSSEFPKPST PPGSSGGAPGILGFVFTLGILGFVFTLKEFTLDFSTAKTYVDSL NVIRSAIGTPLQTISSGGTSLLMIDSGSGDNLFAVDVRGIDPEE GRFNNLRLIVERNNLYVTGFVNRTNNVFYRFADFSHVTFPGT TAVTLSGDSSYTTLQRVAGISRTGMQINRHSLTTSYLDLMSHS GTSLTQSVARAMLRFVTVTAEALRFRQIQRGFRTTLDDLSGRS YVMTAEDVDLTLNWGRLSSVLPDYHGQDSVRVGRISFGSINA ILGSVALILNCHHASAVAAKDEL |
| SEQ ID NO: 720 | exemplary cell-targeting molecule 433 | MAPTSSSTKKTQLQLEHLLLDLQMILNGINNYKNPKLTRMLT FKFYMPKKATELKHLQCLEEELKPLEEVLNLAQSKNFHLRPR DLISNINIVIVLELKGSETTFMCEYADETATIVEFLNRWITFCQSI ISTLTEFPKPSTPPGSSGGAPGILGFVFTLKEFTLDFSTAKTYVD SLNVIRSAIGTPLQTISSGGTSLLMIDSGSGDNLFAVDVRGIDPE EGRFNNLRLIVERNNLYVTGFVNRTNNVFYRFADFSHVTFPG TTAVTLSGDSSYTTLQRVAGISRTGMQINRHSLTTSYLDLMSH SGTSLTQSVARAMLRFVTVTAEALRFRQIQRGFRTTLDDLSGR SYVMTAEDVDLTLNWGRLSSVLPDYHGQDSVRVGRISFGSIN AILGSVALILNCHHASAVAAKDEL |
| SEQ ID NO: 721 | exemplary cell-targeting molecule 434 | MAPTSSSTKKTQLQLEHLLLDLQMILNGINNYKNPKLTRMLT FKFYMPKKATELKHLQCLEEELKPLEEVLNLAQSKNFHLRPR DLISNINIVIVLELKGSETTFMCEYADETATIVEFLNRWITFCQSI ISTLTEFPKPSTPPGSSGGAPGILGFVFTLKEFTLDFSTAKTYVD SLNVIRSAIGTPLQTISSGGTSLLMIDSGSGDNLFAVDVRGIDPE EGRFNNLRLIVERNNLYVTGFVNRTNNVFYRFADFSHVTFPG TTAVTLSGDSSYTTLQRVAGISRTGMQINRHSLTTSYLDLMSH SGTSLTQSVARAMLRFVTVTAEALRFRQIQRGFRTTLDDLSGR SYVMTAEDVDLTLNWGRLSSVLPDYHGQDSVRVGRISFGSIN AILGSVALILNSHHASAVAAKDEL |
| SEQ ID NO: 722 | exemplary cell-targeting molecule 435 | MQVQLVQSGAELVKPGASVKMSCKASGYTFTSYNMHWVKQ TPGQGLEWIGAIYPGNGDTSYNQKFKGKATLTADKSSSTAYM QLSSLTSEDSAVYYCARAQLRPNYWYFDVWGAGTTVTVSSG |

| | | |
|---|---|---|
| | | Sequence Listing |
| ID Number | Text Description | Biological Sequence |
| | | STSGSGKPGSGEGSDIVLSQSPAILSASPGEKVTMTCRASSSVS<br>YMHWYQQKPGSSPKPWIYATSNLASGVPARFSGSGSGTSYSL<br>TISRVEAEDAATYYCQQWISNPPTFGAGTKLELKEFPKPSTPP<br>GSSGGAPGILGFVFTLKEFTLDFSTAKTYVDSLNVIRSAIGTPL<br>QTISSGGTSLLMIDSGSGDNLFAVDVRGIDPEEGRFNNLRLIVE<br>RNNLYVTGFVNRTNNVFYRFADFSHVTFPGTTAVTLSGDSSY<br>TTLQRVAGISRTGMQINRHSLTTSYLDLMSHSGTSLTQSVARA<br>MLRFVTVTAEALRFRQIQRGFRTTLDDLSGRSYVMTAEDVDL<br>TLNWGRLSSVLPDYHGQDSVRVGRISFGSINAILGSVALILNC<br>HHHASAVAA |
| SEQ ID NO: 723 | exemplary cell-targeting molecule 436 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS<br>VSYMDWYQQKPGSSPKPWIYATSNLASGVPARFSGSGSGTSY<br>SLTISRVEAEDAATYYCQQWISNPPTFGAGTKLELKEFPKPSTP<br>PGSSGGAPGILGFVFTLKEFTLDFSTAKTYVDSLNVIRSAIGTP<br>LQTISSGGTSLLMIDSGSGDNLFAVDVRGIDPEEGRFNNLRLIV<br>ERNNLYVTGFVNRTNNVFYRFADFSHVTFPGTTAVTLSGDSS<br>YTTLQRVAGISRTGMQINRHSLTTSYLDLMSHSGTSLTQSVAR<br>AMLRFVTVTAEALRFRQIQRGFRTTLDDLSGRSYVMTAEDVD<br>LTLNWGRLSSVLPDYHGQDSVRVGRISFGSINAILGSVALILNC<br>HHHASAVAA |
| SEQ ID NO: 724 | exemplary cell-targeting molecule 437 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS<br>VSYMDWYQQKPGSSPKPWIYATSNLASGVPARFSGSGSGTSY<br>SLTISRVEAEDAATYYCQQWISNPPTFGAGTKLELKEFPKPSTP<br>PGSSGGAPGILGFVFTLKEFTLDFSTAKTYVDSLNVIRSAIGTP<br>LQTISSGGTSLLMIDSGSGDNLFAVDVRGIDPEEGRFNNLRLIV<br>ERNNLYVTGFVNRTNNVFYRFADFSHVTFPGTTAVTLSGDSS<br>YTTLQRVAGISRTGMQINRHSLTTSYLDLMSHSGTSLTQSVAR<br>AMLRFVTVTAEALRFRQIQRGFRTTLDDLSGRSYVMTAEDVD<br>LTLNWGRLSSVLPDYHGQDSVRVGRISFGSINAILGSVALILNC<br>HHHASAVAA |
| SEQ ID NO: 725 | exemplary cell-targeting molecule 438 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS<br>VSYMDWYQQKPGSSPKPWIYATSNLASGVPARFSGSGSGTSY<br>SLTISRVEAEDAATYYCQQWISNPPTFGAGTKLELKEFPKPSTP<br>PGSSGGAPGILGFVFTLKEFTLDFSTAKTYVDSLNVIRSAIGTP<br>LQTISSGGTSLLMIDSGSGDNLFAVDVRGIDPEEGRFNNLRLIV<br>ERNNLYVTGFVNRTNNVFYRFADFSHVTFPGTTAVTLSGDSS<br>YTTLQRVAGISRTGMQINRHSLTTSYLDLMSHSGTSLTQSVAR<br>AMLRFVTVTAEALRFRQIQRGFRTTLDDLSGRSYVMTAEDVD<br>LTLNWGRLSSVLPDYHGQDSVRVGRISFGSINAILGSVALILNC<br>HHHASAVAA |
| SEQ ID NO: 726 | exemplary cell-targeting molecule 439 | MQVQLQQPGAELVKPGASVKMSCKASGYTFTSYNMHWVKQ<br>TPGRGLEWIGAIYPGNGDTSYNQKFKGKATLTADKSSSTAYM<br>QLSSLTSEDSAVYYCARSTYYGGDWYFNVWGAGTTVTVSAG<br>STSGSGKPGSGEGSTKGQIVLSQSPAILSASPGEKVTMTCRASS<br>SVSYIHWFQQKPGSSPKWIYATSNLASGVPVRFSGSGSGTSY<br>SLTISRVEAEDAATYYCQQWTSNPPTFGGGTKLEIKEFPKPSTP<br>PGSSGGAPGILGFVFTLKEFTLDFSTAKTYVDSLNVIRSAIGTP<br>LQTISSGGTSLLMIDSGSGDNLFAVDVRGIDPEEGRFNNLRLIV<br>ERNNLYVTGFVNRTNNVFYRFADFSHVTFPGTTAVTLSGDSS<br>YTTLQRVAGISRTGMQINRHSLTTSYLDLMSHSGTSLTQSVAR<br>AMLRFVTVTAEALRFRQIQRGFRTTLDDLSGRSYVMTAEDVD<br>LTLNWGRLSSVLPDYHGQDSVRVGRISFGSINAILGSVALILNC<br>HHHASAVAA |
| SEQ ID NO: 727 | exemplary cell-targeting molecule 440 | MEVQLVESGGGLVQPGRSLRLSCAASGFTFNDYAMHWVRQA<br>PGKGLEWVSTISWNSGSIGYADSVKGRFTISRDNAKKSLYLQ<br>MNSLRAEDTALYYCAKDIQYGNYYYGMDVWGQGTTVTVSS<br>GSTSGSGKPGSGEGSEIVLTQSPATLSLSPGERATLSCRASQSV<br>SSYLAWYQQKPGQAPRLLIYDASNRATGIPARFSGSGSGTDFT<br>LTISSLEPEDFAVYYCQQRSNWPITFGQGTRLEIKEFPKPSTPPG<br>SSGGAPGILGFVFTLKEFTLDFSTAKTYVDSLNVIRSAIGTPLQ |

| Sequence Listing | | |
|---|---|---|
| ID Number | Text Description | Biological Sequence |
| | | TISSGGTSLLMIDSGSGDNLFAVDVRGIDPEEGRFNNLRLIVER<br>NNLYVTGFVNRTNNVFYRFADFSHVTFPGTTAVTLSGDSSYT<br>TLQRVAGISRTGMQINRHSLTTSYLDLMSHSGTSLTQSVARA<br>MLRFVTVTAEALRFRQIQRGFRTTLDDLSGRSYVMTAEDVDL<br>TLNWGRLSSVLPDYHGQDSVRVGRISFGSINAILGSVALILNC<br>HHHASAVAA |
| SEQ ID NO: 728 | exemplary cell-targeting molecule 441 | MEIVLTQSPATLSLSPGERATLSCRASQSVSSYLAWYQQKPGQ<br>APRLLIYDASNRATGIPARFSGSGSGTDFTLTISSLEPEDFAVY<br>YCQQRSNWPITFGQGTRLEIKGGGGSGGGGSGGGGSGGGGSG<br>GGGSEVQLVESGGGLVQPGRSLRLSCAASGFTFNDYAMHWV<br>RQAPGKGLEWVSTISWNSGSIGYADSVKGRFTISRDNAKKSL<br>YLQMNSLRAEDTALYYCAKDIQYGNYYYGMDVWGQGTTVT<br>VSSEFPKPSTPPGSSGGAPGILGFVFTLKEFTLDFSTAKTYVDS<br>LNVIRSAIGTPLQTISSGGTSLLMIDSGSGDNLFAVDVRGIDPEE<br>GRFNNLRLIVERNNLYVTGFVNRTNNVFYRFADFSHVTFPGT<br>TAVTLSGDSSYTTLQRVAGISRTGMQINRHSLTTSYLDLMSHS<br>GTSLTQSVARAMLRFVTVTAEALRFRQIQRGFRTTLDDLSGRS<br>YVMTAEDVDLTLNWGRLSSVLPDYHGQDSVRVGRISFGSINA<br>ILGSVALILNCHHHASAVAA |
| SEQ ID NO: 729 | exemplary cell-targeting molecule 442 | MQIVLSQSPAILSASPGEKVTMTCRASSSVSYMHWYQQKPGS<br>SPKPWIYAPSNLASGVPARFSGSGSGTSYSLTISRVEAEDAATY<br>YCQQWSFNPPTFGAGTKLELKSGGGGSGGGGSGGGGSGGGG<br>SGGGGSQAYLQQSGAELVRPGASVKMSCKASGYTFTSYNMH<br>WVKQTPRQGLEWIGAIYPGNGDTSYNQKEKGKATLTVDKSSS<br>TAYMQLSSLTSEDSAVYFCARVVYYSNSYWYFDVWGTGTTV<br>TVSEFPKPSTPPGSSGGILGFVFTLGAPKEFTLDFSTAKTYVDS<br>LNVIRSAIGTPLQTISSGGTSLLMIDSGSGDNLFAVDVRGIDPEE<br>GRFNNLRLIVERNNLYVTGFVNRTNNVFYRFADFSHYTFPGT<br>TAVTLSGDSSYTTLQRVAGISRTGMQINRHSLTTSYLDLMSHS<br>GTSLTQSVARAMLRFVTVTAEALRFRQIQRGFRTTLDDLSGRS<br>YVMTAEDVDLTLNWGRLSSVLPDYHGQDSVRVGRISFGSINA<br>ILGSVALILNCHHHASAVAA |
| SEQ ID NO: 730 | exemplary cell-targeting molecule 443 | MQAYLQQSGAELVRPGASVKAISCKASGYTFTSYNMHWVKQ<br>TPRQGLEWIGAIYPGNGDTSYNQKFKGKATLTVDKSSSTAYM<br>QLSSLTSEDSAVYFCARVVYYSNSYWYFDVWGTGTTVTVSG<br>STSGSGKPGSGEGSQIVLSQSPAILSASPGEKVTMTCRASSSVS<br>YMHWYQQKPGSSPKPWIYAPSNLASGVPARFSGSGSGTSYSL<br>TISRVEAEDAATYYCQQWSFNPPTFGAGTKLELKSEFPKPSTP<br>PGSSGGAPGILGFVFTLKEFTLDFSTAKTYVDSLNVIRSAIGTP<br>LQTISSGGTSLLMIDSGSGDNLFAVDVRGIDPEEGRFNNLRLIV<br>ERNNLYVTGFVNRTNNVFYRFADFSHVTFPGTTAVTLSGDSS<br>YTTLQRVAGISRTGMQINRHSLTTSYLDLMSHSGTSLTQSVAR<br>AMLRFVTVTAEALRFRQIQRGFRTTLDDLSGRSYVMTAEDVD<br>LTLNWGRLSSVLPDYHGQDSVRVGRISFGSINAILGSVALILNC<br>HHHASAVAA |
| SEQ ID NO: 731 | exemplary cell-targeting molecule 444 | ASVSDVPRDLEVVAATPTSLLISWCRQRCADSYRITYGETGGN<br>SPVQEFTVPGSWKTATISGLKPGVDYTITVYVVTHYYGWDRY<br>SHPISINYRTGSEFPKPSTPPGSSGGAPGILGFVFTLKEFTLDFST<br>AKTYVDSLNVIRSAIGTPLQTISSGGTSLLMIDSGSGDNLFAVD<br>VRGIDPEEGRFNNLRLIVERNNLSVTGFVNRTNNVFYRFADFS<br>HVTFPGTTAVTLSGDSSYTTLQRVAGISRTGMQINRHSLTTSY<br>LDLMSHSGTSLTQSVARAMLRFVTVTADALRFRQIQRGFRTT<br>LDDLSGRSYVMTAEDVDLTLNWGRLSSVLPDYHGQDSVRVG<br>RISFGSINAILGSVALILNCHHHASAVAA |
| SEQ ID NO: 732 | exemplary cell-targeting molecule 445 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS<br>VSYMDWYQQKPGSSPKPWIYATSNLASGVPARFSGSGSGTSY<br>SLTISRVEAEDAATYYCQQWISNPPTFGAGTKLELKEFPKPSTP<br>PGSSGGAPGILGFVFTLKEFTLDFSTAKTYVDSENVIRSAIGTP<br>LQTISSGGTSLLMIDSGSGDNLFAVDVRGIDPEEGRFNNLRLIV<br>ERNNLYVTGFVNRTNNVFYRFADFSHVTFPGTTAVTLSGDSS<br>YTTLQRVAGISRTGMQINRHSLTTSYLDLMSHSGTSLTQSVAR<br>AMLRFVTVTAEALREFQIQRGFRTTLDDLSGRSYVMTAEDVD<br>LTLNWGRLSSVLPDYHGQDSVRVGRISEFSINAILGSVALILNC<br>HHHASAVAACITGDALVALPEGESVRIADIVPGARPNSDNAID<br>LKVLDRHGNPVLADRLFHSGEHPVYTVRTVEGLRVTGTANH<br>PLLCLVDVAGVPTLLWKLIDEIKPGDYAVIQRSAFSVDCAGFA |

| | | |
|---|---|---|
| | | RGKPEFAPTTYTVGVPGLVRFLEAHHRDPDAQAIADELTDGR<br>FYYAKVASVTDAGVQPVYSLRVDTADHAFITNGFVSHATGLT<br>GLNSGLTTNPGVSAWQVNTAYTAGQLVTYNGKTYKCLQPHT<br>SLAGWEPSNVPALWQLQ |
| SEQ ID<br>NO: 733 | exemplary<br>cell-targeting<br>molecule 446 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS<br>VSYMDWYQQKPGSSPKPWIYATSNLASGVPARFSGSGSGTSY<br>SLTISRVEAEDAATYYCQQWISNPPTFGAGTKLELKEFPKPSTP<br>PGSSGGAPGILGFVFTLKEFTLDFSTAKTYVDSLNVIRSAIGTP<br>LQTISSGGTSLLMIDSGSGDNLFAVDVRGIDPEEGRFNNLRLIV<br>ERNNLYVTGFVNRTNNVFYRFADFSHVTFPGTTAVTLSGDSS<br>YTTLQRVAGISRTGMQINRHSLTTSYLDLMSHSGTSLTQSVAR<br>AMLRFVTVTAEALRFRQIQRGFRTTLDDLSGRSYVMTAEDVD<br>LTLNWGRLSSVLPDYHGQDSVRVGRISFGSINAILGSVALILNC<br>HHHASAVAACITGDALVALPEGESVRIADIVPGARPNSDNAID<br>LKVLDRHGNPVLADRLFHSGEHPVYTVRTVEGLRVTGTANH<br>PLLCLVDVAGVPTLLWKLIDEIKPGDYAVIQRSAFSVDCAGFA<br>RGKPEFAPTTYTVGVPGLVRFLEAHHRDPDAQAIADELTDGR<br>FYYAKVASVTDAGVQPVYSLRVDTADHAFITNGFVSHATGLT<br>GLNSGLTTNPGVSAWQVNTAYTAGQLVTYNGKTYKCLQPHT<br>SLAGWEPSNVPALWQLQ |
| SEQ ID<br>NO: 734 | exemplary<br>cell-targeting<br>molecule 447 | MQVQLQQPGAELVKPGASVKMSCKTSGYTFTSYNVHWVKQ<br>TPGQGLEWIGAIYPGNGDTSFNQKFKGKATLTADKSSSTVYM<br>QLSSLTSEDSAVYYCARSNYYGSSYVWFFDVWGAGTTVTVS<br>SGSTSGSGKPGSGEGSQIVLSQSPTILSASPGEKVTMTCRASSS<br>VSYMDWYQQKPGSSPKPWIYATSNLASGVPARFSGSGSGTSY<br>SLTISRVEAEDAATYYCQQWISNPPTFGAGTKLELKEFPKPSTP<br>PGSSGGAPGILGFVFTLKEFTLDFSTAKTYVDSLNVIRSAIGTP<br>LQTISSGGTSLLMIDSGSGDNLFAVDVRGIDPEEGRFNNLRLIV<br>ERNNLYVTGFVNRTNNVFYRFADFSHVTFPGTTAVTLSGDSS<br>YTTLQRVAGISRTGMQINRHSLTTSYLDLMSHSGTSLTQSVAR<br>AMLRFVTVTAEALRFRQIQRGFRTTLDDLSGRSYVMTAEDVD<br>LTLNWGRLSSVLPDYHGQDSVRVGRISFGSINAILGSVALILNC<br>HHHASAVAAKDEL |
| SEQ ID<br>NO: 735 | exemplary<br>cell-targeting<br>molecule 448 | MKEFTLDFSTAKTYVDSLNVIRSAIGTPLQTISSGGTSLLMIDS<br>GSGDNLFAVDVRGIDPEEGRFNNLRLIVERNNLYVTGFVNRT<br>NNVFYRFADFSHVTFPGTTAVTLSGDSSYTTLQRVAGISRTGM<br>QINRHSLTTSYLDLMSHSGTSLTQSVARAMLRFVTVTAEALRF<br>RQIQRGFRTTLDDLSGRSYVMTAEDVDLTLNWGRLSSVLPDY<br>HGQDSVRVGRISFGSINAILGSVALILNCHHHASAVAAEFPKPS<br>TPPGSSGGAPGILGFVFTLMQVQLQQPGAELVKPGASVKMSC<br>KTSGYTFTSYNVHWVKQTPGQGLEWIGAIYPGNGDTSFNQKF<br>KGKATLTADKSSSTVYMQLSSLTSEDSAVYYCARSNYYGSSY<br>VWFFDVWGAGTTVTVSSGSTSGSGKPGSGEGSQIVLSQSPTIL<br>SASPGEKVTMTCRASSSVSYMDWYQQKPGSSPKPWIYATSNL<br>ASGVPARFSGSGSGTSYSLTISRVEAEDAATYYCQQWISNPPT<br>FGAGTKLELK |
| SEQ ID<br>NO: 736 | exemplary<br>cell-targeting<br>molecule 449 | MKEFTLDESTAKTYVDSLNVIRSAIGTPLQPISSGGTSLLMIDS<br>GSGDNLFAVDVRGIDPEEGRFNNLRLIVERNNLYVTGFVNRT<br>NNVFYRFADFSHVTFPGTTAVTLSGDSSYTTLQRVAGISRTGM<br>QINRHSLTTSYLDLMSHSGTSLTQSVARAMLRFVTVTAEALRF<br>RQIQRGFRTTLDDLSGRSYVMTAEDVDLTLNWGRLSSVLPDY<br>HGQDSVRVGRISFGSINAILGSVALILNCHHHASAVAAEFPKPS<br>TPPGSSGGAPGILGFVFTLDIELTQSPSSFSVSLGDRVTITCKAS<br>EDIYNRLAWYQQKPGNAPRLLISGATSLETGVPSRFSGSGSGK<br>DYTLSITSLQTEDVATYYCQQYWSTPTFGGGTKLEIKGSTSGS<br>GKPGSGEGSKVQLQESGPSLVQPSQRLSITCTVSGFSLISYGVH<br>WVRQSPGKGLEWLGVIWRGGSTDYNAAFMSRLSITKDNSKS<br>QVFFKMNSLQADDTAIYFCAKTLITTGYAMDYWGQGTTVTV<br>SS |
| SEQ ID<br>NO: 737 | exemplary<br>cell-targeting<br>molecule 450 | MKEFTLDFSTAKTYVDSLNVIRSAIGTPLQTISSGGTSLLMIDS<br>GSGDNLFAVDVRGIDPEEGRFNNLRLIVERNNLYVTGFVNRT<br>NNVFYRFADFSHVTFPGTTAVTLSGDSSYTTLQRVAGISRTGM<br>QINRHSLTTSYLDLMSHSGTSLTQSVARAMLRFVTVTAEALRF<br>RQIQRGFRTTLDDLSGRSYVMTAEDVDLTLNWGRLSSVLPDY<br>HGQDSVRVGRISFGSINAILGSVALILNCHHHASAVAAEFPKPS<br>TPPGSSGGAPGILGFVFTLDIELTQSPSSFSVSLGDRVTITCKAS |

| | | |
|---|---|---|
| ID Number | Text Description | Biological Sequence |
| | | EDIYNRLAWYQQKPGNAPRLLISGATSLETGVPSRFSGSGSGK DYTLSITSLQTEDVATYYCQQYWSTPTFGGGTKLEIKGSTSGS GKPGSGEGSKVQLQESGPSLVQPSQRLSITCTVSGFSLISYGVH WVRQSPGKGLEWLGVIWRGGSTDYNAAFMSRLSITKDNSKS QVFFKMNSLQADDTAIYFCAKTLITTGYAMDYWGQGTTVTV SS |
| SEQ ID NO: 738 | exemplary cell-targeting molecule 451 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPGILGFVFTLDIQMTQSPSSLSASVGDRVTITCRA SQDVNTAVAWYQQKPGKAPKLLIYSASFLYSGVPSRFSGSRS GTDFTLTISSLQPEDFATYYCQQHYTTPPTFGQGTKVEIKRTGS TSGSGKPGSGEGSEVQLVESGGGLVQPGGSLRLSCAASGFNIK DTYIHWVRQAPGKGLEWVARIYPTNGYTRYADSVKGRFTISA DTSKNTAYLQMNSLRAEDTAVYYCSRWGGDGFYAMDVWG QGTLVTVSS |
| SEQ ID NO: 739 | exemplary cell-targeting molecule 452 | MKEFTLDESTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPGILGFVFTLDIQMTQSPSSLSASVGDRVTITCRA SQDVNTAVAWYQQKPGKAPKLLIYSASFLYSGVPSRFSGSRS GTDFTLTISSLQPEDFATYYCQQHYTTPPTFGQGTKVEIKRTGS TSGSGKPGSGEGSEVQLVESGGGLVQPGGSLRLSCAASGFNIK DTYIHWVRQAPGKGLEWVARIYPTNGYTRYADSVKGRFTISA DTSKNTAYLQMNSLRAEDTAVYYCSRWGGDGFYAMDVWG QGTLVTVSS |
| SEQ ID NO: 740 | exemplary cell-targeting molecule 453 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPGILGFVFTLDIVMTQAAPSIPVTPGESVSISCRSS KSLLNSNGNTYLYWFLQRPGQSPQLLIYRMSNLASGVPDRFS GSGSGTAFTLRISRVEAEDVGVYYCMQHLEYPFTFGAGTKLE LKGSTSGSGKPGSGEGSEVQLQQSGPELIKPGASVKMSCKASG YTFTSYVMHWVKQKPGQGLEWIGYINPYNDGTKYNEKFKGK ATLTSDKSSSTAYMELSSLTSEDSAVYYCARGTYYYGSRVFD Y2GQGTTLTVSS |
| SEQ ID NO: 741 | exemplary cell-targeting molecule 454 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPGILGFVFTLDIVMTQAAPSIPVTPGESVSISCRSS KSLLNSNGNTYLYWFLQRPGQSPQLLIYRMSNLASGVPDRFS GSGSGTAFTLRISRVEAEDVGVYYCMQHLEYPFTFGAGTKLE LKGSTSGSGKPGSGEGSEVQLQQSGPELIKPGASVKMSCKASG YTFTSYVMHWVKQKPGQGLEWIGYINPYNDGTKYNEKFKGK ATLTSDKSSSTAYMELSSLTSEDSAVYYCARGTYYYGSRVFD YWGQGTTLTVSS |
| SEQ ID NO: 742 | exemplary cell-targeting molecule 455 | MKEFTLDFSTAKTYVDSLNVIRSAIGTPLQTISSGGTSLLMIDS GSGDNLFAVDVRGIDPEEGRFNNLRLIVERNNLYNTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPGILGFVFTLDIQLTQSPLSLPVTLGQPASISCRSS QSLVHRNGNTYLHWFQQRPGQSPLLIYTVSNRFSGVPDRFS |

Sequence Listing

| ID Number | Text Description | Biological Sequence |
|---|---|---|
| | | GSGSGTDFTLKISRVEAEDVGVYFCSQSSHVPPTFGAGIRLEIK GSTSGSGKPGSGEGSTKGQVQLQQSGSELKKPGASVKVSCKA SGYTFTNYGVNWIKQAPGQGLQWMGWINPNTGEPTFDDDFK GRFAFSLDTSVSTAYLQISSLKADDTAVYFCSRSRGKNEAWF AYWGQGTLVTVSS |
| SEQ ID NO: 743 | exemplary cell-targeting molecule 456 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPGILGFVFTLDIQLTQSPLSLPVTLGQPASISCRSS QSLVRHRNGNTYLHWFQQRPGQSPRLLITYTVSNRFSGVPDRFS GSGSGTDFTLKISRVEAEDVGVYFCSQSSHVPPTFGAGTRLEIK GSTSGSGKPGSGEGSTKGQVQLQQSGSELKKPGASVKVSCKA SGYTFTNYGVNWIKQAPGQGLQWMGWINPNTGEPTFDDDFK GRFAFSLDTSVSTAYLQISSLKADDTAVYFCSRSRGKNEAWF AYWGQGTLVTVSS |
| SEQ ID NO: 744 | exemplary cell-targeting molecule 457 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAAHHSE DPSSKAPKAPGILGFVFTLEVQLVESGGGLVQAGGSLRLSCAA SGITFSINTMGWYRQAPGKQRELVALISSIGDTYYADSVKGRF TISRDNAKNTVYLQMNSLKPEDTAVYYCKRFRTAAQGTDYW GQGTQVTVSS |
| SEQ ID NO: 745 | exemplary cell-targeting molecule 458 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPGILGFVFTLEVQLVESGGGLVQAGGSLRLSCAA SGITFSINTMGWYRQAPGKQRELVALISSIGDTYYADSVKGRF TISRDNAKNTVYLQMNSLKPEDTAVYYCKRFRTAAQGTDYW GQGTQVTVSS |
| SEQ ID NO: 746 | exemplary cell-targeting molecule 459 | MKEFILDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAAHHSE DPSSKAPKAPGILGFVFTLEVQLVESGGGLVQAGGSLRLSCAA SGITFSINTMGWYRQAPGKQRELVALISSIGDTYYADSVKGRF TISRDNAKNTVYLQMNSLKPEDTAVYYCKRFRTAAQGTDYW GQGTQVTVSS |
| SEQ ID NO: 747 | exemplary cell-targeting molecule 460 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPGILGFVFTLDIVLTQSPASLAVSLGQRATISCRA TESVEYYGTSLVQWYQQKPGQPPKLLIYAASSVDSGVPARFS GSGSGTDFSLTIHPVEEDDIAMYFCQQSRRVPYTFGGGTKLEI KGGGGSEVQLQQSGPELNKPGASVKMSCKASGYTFTSYVMH WVKQKPGQGLEWIGYVNPFNDGTKYNEMFKGKATLTSDKSS STAYMELSSLTSEDSAVYYCARQAWGYPWGQGTLVTVSA |
| SEQ ID NO: 748 | exemplary cell-targeting molecule 461 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKPS TPPGSSGGAPGILGFVFTLDIVLIQSPASLAVSLGQRATISCRA TESVEYYGTSLVQWYQQKPGQPPKLLIYAASSVDSGVPARFS |

-continued

Sequence Listing

| ID Number | Text Description | Biological Sequence |
|---|---|---|
| | | GSGSGTDFSLITHPVEEDDIAMYFCQQSRRVPYTFGGGTKLEI KGGGGSEVQLQQSGPELVKPGASVKMSCKASGYTFTSYVMH WVKQKPGQGLEWIGYVNPFNDGTKYNEMIFKGKATLTSDKSS STAYMELSSLTSEDSAVYYCARQAWGYPWGQGTLVTVSA |
| SEQ ID NO: 749 | exemplary cell-targeting molecule 461 | MKEFTLDFSTAKTYVDSLNVIRSAIGTPLQTISSGGTSLLMIDS GSGDNLFAVDVRGIDPEEGRFNNLRLIVERNNLYVTGFVNRT NNVFYRFADFSHVTFPGTTAVTLSGDSSYTTLQRVAGISRTGM QINRHSLTTSYLDLMSHSGTSLTQSVARAMLRFVTVTAEALRF RQIQRGFRTTLDDLSGRSYVMTAEDVDLTLNWGRLSSVLPDY HGQDSVRVGRISFGSINAILGSVALILNCHHHASAVAAEFPKTS TPPGSSGGAPGILGFVFTLDIVLTQSPASLAVSLGQRATISCRA TESVEYYGTSLVQWYQQKPGQPPKLLIYAASSVDSGVPARFS GSGSGTDFSLTIHPVEEDDIAMYFCQQSRRVPYTFGGGTKLEI KGGGGSEVQLQQSGPELVKPGASVKMSCKASGYTFTSYVMH WVKQKPGQGLEWIGYVNPFNDGTKYNEMFKGKATLTSDKSS STAYMELSSETSEDSAVYYCARQAWGYPWGQGTLVTVSANL VPMVATV |

SEQUENCE LISTING (800 sequences)

SEQ ID NO: 1 - protein, 293 aa, Escherichia coli
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 2 - protein, 293 aa, Shigella dysenteriae
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 3 - protein, 297 aa, Escherichia coli
DEFTVDFSSQKSYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQKQKTECQIVGDRAAIKVNNVLWEANTIAALLNRKPQDLTEPNQ

SEQ ID NO: 4 - protein, 251 aa, Escherichia coli
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSVNAILGSVALILNCHHHASRVAR

SEQ ID NO: 5 - protein, 251 aa, Escherichia coli
KEFTLDFSTAKKYVDSLNVIRSAIGTPLQTISSGGTSLLMIDSGTGDNLFAVDIMGLEPEEERFNNLRLIVERNNLYVTGFVNRTNNVFYRFADFSHVTFPGTRAVTLSGDSSYTTLQRVAGISRTGMQINRHSLTTSYLDLMSYSGTSLTQSVARAMLRFVTVTAEALRFRQIQRGFRTTLDDLSGRSYVMTAEDVDLTLNWGRLSSILPDYHGQDSVRVGRISFGSINAILGSVALILNCHHHASRVAR

SEQ ID NO: 6 - protein, 251 aa, Escherichia coli
QDFTVDFSTAKKYVDSLNAIRSAIGTPLHSISSGGTSLLMIDNGTGDNLFAVDIRGLDPEEERFDNLRLIIERNNLYVTGFVNRTSNIFYRFADFSHVTFPGTRAVTLSGDSSYTTLQRVAGIGRTGMQINRHSLTTSYLDLMSYSGSSLTQPVARAMLRFVTVTAEALRFRQIQRGFRTTLDDVSGHSYTMTVEDVDLTLNWGRLSSVLPDYHGQDSVRVGRISFGGVNAILGSVALILNCHHHTSRVSR

SEQ ID NO: 7 - protein, 250 aa, Escherichia coli
REFTIDFSTQQSYVSSLNSIRTEISTPLEHISQGTTSVSVINHTPPGSYFAVDIRGLDVYQARFDHLRLIIEQNNLYVAGFVNTATNTFYRFSDFTHISVPGVTTVSMTTDSSYTTLQRVAALERSGMQISRHSLVSSYLALMEFSGNTMTRDASRAVLRFVTVTAEALRFRQIQREFRQALSETAPVYTMTPGDVDLTLNWGRISNVLPEYRGEDGVRVGRISFNNISAILGTVAVILNCHHQGARSVR

SEQ ID NO: 8 - protein, 250 aa, Escherichia coli
REFTIDFSTQQSYVSSLNSIRTEISTPLEHISQGTTSVSVINHTPPGSYFAVDIRGLDVYQARFDHLRLIIEQNNLYVAGFVNTATNTFYRFSDFAHISVPGVTTVSMTTDSSYTTLQRVAALERSGMQISRHSLVSSYLALMEFSGNTMTRDASRAVLRFVTVTAEALRFRQIQREFRQALSETAPVYTMTPGDVDLTLNWGRISNVLPEYRGEDGVRVGRISFNNISAILGTVAVILNCHHQGARSVR

SEQ ID NO: 9 - protein, 250 aa, Escherichia coli
REFTIDFSTQQSYVSSLNSIRTEISTPLEHISQGTTSVSVINHTPPGSYFAVDIRGLDIYQARFDHLRLIIEQNNLYVAGFVNTATNTFYRFSDFTHISVPGVTTVSMTTDSSYTTLQRVAALERSGMQISRHSLVSSYLALMEFSGNTMTRDASRAVLRFVTVTAEALRFRQIQREFRQALSETAPVYTMTPGDVDLTLNWGRISNVLPEYRGEDGVRVGRISFNNISAILGTVAVILNCHHQGARSVR

SEQ ID NO: 10 - protein, 250 aa, Escherichia coli
REFTIDFSTQQSYVSSLNSIRTEISTPLEHISQGTTSVSVINHTPPGSYFAVDIRGLDVYQARFDHLRLIIEQNNLYVAGFVNTATNTFYRFSDFTHISVPSVTTVSMTTDSSYTTLQRVAALERSGMQISRHSLVSSYLALMEFSGNTMTRDASRAVLRFVTVTAEALRFRQIQREFRQALSETAPVYTMTPGDVDLTLNWGRISNVLPEYRGEDGVRVGRISFNNISAILGTVAVILNCHHQGARSVR

SEQ ID NO: 11 - protein, 250 aa, Escherichia coli
REFTIDFSTQQSYVSSLNSIRTEISTPLEHISQGTTSVSVINHTPPGSYFAVDIRGLDVYQARFDHLRLIIEQNNLYMAGFVNTATNTFYRFSDFTHISVPSVTTVSMTTDSSYTTLQRVAALERSGMQISRHSLVSSYLALMEFSGNTMTRDASRAVLRFVTVTAEALRFRQIQREFRQALSETAPVYTMTPGDVDLTLNWGRISNVLPEYRGEDGVRVGRISFNNISAILGTVAVILNCHHQGARSVR

SEQ ID NO: 12 - protein, 250 aa, Escherichia coli
REFTIDFSTQQSYVSSLNSIRTEISTPLEHISQGTTSVSVINHTPPGSYFAVDIRGLDVYQARFDHLRLIIEQNNLYVAGFVNTATNTFYRFSDFTHISVPGVTTVSMTTDSSYTTLQRVAALERSGMQISRHSLVSSYLALMEFSGNTMTRDASRAVLRFVTVTAEALRFRQIQREFRQVLSETAPVYTMTPGDVDLTLNWGRISNVLPEYRGEDGVRVGRISFNNISAILSTVAVILNCHHQGARSVR

SEQ ID NO: 13 - protein, 250 aa, Escherichia coli
REFTIDFSTQQSYVSSLNSIRTEISTPLEHISQGTTSVSVINHTPPGSYFAVDIRGLDVYQARFDHLRLIIEQNNLYVAGFVNTATNTFYRFSDFAHISVPGVTTVSMTTDSSYTTLQRVAALERSGMQISRHSLVSSYLALMEFSGNTMTRDASRAVLRFVTVTAEALRFRQIQREFRQALSETAPVYTMTPGDVDLTLNWGRISNVIPEYRGEDGVRVGRISFNNISAILGTVAVILNCHHQGARSVR

SEQ ID NO: 14 - protein, 250 aa, Escherichia coli
REFMIDFSTQQSYVSSLNSIRTEISTPLEHISQGTTSVSVINHTPPGSYFAVDIRGLDVYQARFDHLRLIIEQNNLYVAGFVNTATNTFYRFSDFTHISVPGVTTVSMTTDSSYTTLQRVAALERSGMQISRHSLVSSYLALMEFSGNTMTRDASRAVLRFVTVTAEALRFRQIQREFRQALSETAPVYTMTPEEVDLTLNWGRISNVLPEFRGEGGVRVGRISFNNISAILGTVAVILNCHHQGARSVR

SEQ ID NO: 15 - protein, 250 aa, Escherichia coli
REFTIDFSTQQSYVSSLNSIRTEISTPLEHISQGTTSVSVINHTPPGSYFAVDIRGLDVYQARFDHLRLIIEQNNLYVAGFVNTATNTFYRFSDFTHISVPGVTTVSMTTDSSYTTLQRVAALERSGMQISRHSLVSSYLALMEFSGNTMTRDASRAVLRFVTVTAEALRFRQIQREFRQALSETAPVYTMTPGDVDLTLNWGRISNVIPEYRGEDGVRVGRISFNNISAILSTVAVILNCHHQGARSVR

SEQ ID NO: 16 - protein, 250 aa, Escherichia coli
QEFTIDFSTQQSYVSSLNSIRTAISTPLEHISQGATSVSVINHTPPGSYISVGIRGLDVYQERFDHLRLIIERNNLYVAGFVNTTTNTFYRFSDFAHISLPGVTTISMTTDSSYTTLQRVAALERSGMQISRHSLVSSYLALMEFSGNTMTRDASRAVLRFVTVTAEALRFRQIQREFRLALSETAPVYTMTPEDVDLTLNWGRISNVLPEYRGEAGVRVGRISFNNISAILGTVAVILNCHHQGARSVR

SEQ ID NO: 17 - protein, 250 aa, Escherichia coli
QEFTIDFSTQQSYVSSLNSIRTAISTPLEHISQGATSVSVINHTPPGSYISVGIRGLDVYQAHFDHLRLIIEQNNLYVAGFVNTATNTFYRFSDFAHISLPGVTTISMTTDSSYTTLQRVAALERSGMQISRHSLVSSYLALMEFSGNTMTREASRAVLRFVTVTAEALRFRQIQREFRQALSETAPVYTMTPEDVDLTLNWGRISNVLPEYRGEDGVRVGRISFNNISAILGTVAVILNCHHQGARSVR

SEQ ID NO: 18 - protein, 250 aa, Escherichia coli
DEFTVDFSSQKSYVDSLNSIRSAISTPLGNISQGGVSVSVINHVPGGNYISLNVRGLDPYSERFNHLRLIMERNNLYVAGFINTETNTFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVR

SEQ ID NO: 19 - protein, 9 aa, Human cytomegalovirus
VTEHDTLLY

SEQ ID NO: 20 - protein, 9 aa, Human cytomegalovirus
GLDRNSGNY

SEQ ID NO: 21 - protein, 9 aa, Human cytomegalovirus
NLVPMVATV

SEQ ID NO: 22 - protein, 9 aa, Human cytomegalovirus
GVMTRGRLK

SEQ ID NO: 23 - protein, 9 aa, Human cytomegalovirus
VYALPLKML

SEQ ID NO: 24 - protein, 9 aa, Human cytomegalovirus
QYDPVAALF

SEQ ID NO: 25 - protein, 9 aa, Human influenza A virus
GILGFVFTL

SEQ ID NO: 26 - protein, 9 aa, Human influenza A virus
ILRGSVAHK

SEQ ID NO: 27 - protein, 9 aa, Human herpesvirus 4
CLGGLLTMV

SEQ ID NO: 28 - protein, 31 aa, Artificial Sequence
  source: /note="Description of Artificial Sequence: Synthetic polypeptide"
NLVPMVATVRRNLVPMVATVRRNLVPMVATV

SEQ ID NO: 29 - protein, 251 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 30 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 31 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 32 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 33 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 34 - protein, 251 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 35 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 36 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 37 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSAARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 38 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 39 - protein, 8 aa, Artificial Sequence
  source: /note="Description of Artificial Sequence: Synthetic peptide"
QDISNYLA

SEQ ID NO: 40 - protein, 11 aa, Artificial Sequence
  source: /note="Description of Artificial Sequence: Synthetic peptide"
LLIYYTSILHS

SEQ ID NO: 41 - protein, 8 aa, Artificial Sequence
  source: /note="Description of Artificial Sequence: Synthetic peptide"
QQGNTLPW

SEQ ID NO: 42 - protein, 9 aa, Artificial Sequence
  source: /note="Description of Artificial Sequence: Synthetic peptide"
YTFTSYWLH

SEQ ID NO: 43 - protein, 14 aa, Artificial Sequence
  source: /note="Description of Artificial Sequence: Synthetic peptide"
WIGYINPRNDYTEY

SEQ ID NO: 44 - protein, 8 aa, Artificial Sequence
  source: /note="Description of Artificial Sequence: Synthetic peptide"
RRDITTFY

SEQ ID NO: 45 - protein, 14 aa, Artificial Sequence
  source: /note="Description of Artificial Sequence: Synthetic peptide"
QSVLYSANHKNYLA

SEQ ID NO: 46 - protein, 11 aa, Artificial Sequence
  source: /note="Description of Artificial Sequence: Synthetic peptide"
LLIYWASTRES

SEQ ID NO: 47 - protein, 7 aa, Artificial Sequence
  source: /note="Description of Artificial Sequence: Synthetic peptide"
HQYLSSW

SEQ ID NO: 48 - protein, 9 aa, Artificial Sequence
  source: /note="Description of Artificial Sequence: Synthetic peptide"
YEFSRSWMN

SEQ ID NO: 49 - protein, 18 aa, Artificial Sequence
  source: /note="Description of Artificial Sequence: Synthetic peptide"
WVGRIYPGDGDTNYSGKF

SEQ ID NO: 50 - protein, 12 aa, Artificial Sequence
  source: /note="Description of Artificial Sequence: Synthetic peptide"
RDGSSWDWYFDV

SEQ ID NO: 51 - protein, 13 aa, Artificial Sequence
  source: /note="Description of Artificial Sequence: Synthetic peptide"
QSIVHSVGNTFLE

SEQ ID NO: 52 - protein, 11 aa, Artificial Sequence
  source: /note="Description of Artificial Sequence: Synthetic peptide"
LLIYKVSNRFS

SEQ ID NO: 53 - protein, 8 aa, Artificial Sequence
  source: /note="Description of Artificial Sequence: Synthetic peptide"
FQGSQFPY

SEQ ID NO: 54 - protein, 10 aa, Artificial Sequence
  source: /note="Description of Artificial Sequence: Synthetic peptide"
GYRFTNYWIH

SEQ ID NO: 55 - protein, 17 aa, Artificial Sequence
  source: /note="Description of Artificial Sequence: Synthetic peptide"
GINPGNNYATYRRKFQG

SEQ ID NO: 56 - protein, 12 aa, Artificial Sequence
  source: /note="Description of Artificial Sequence: Synthetic peptide"
EGYGNYGAWFAY

SEQ ID NO: 57 - protein, 16 aa, Artificial Sequence
  source: /note="Description of Artificial Sequence: Synthetic peptide"
RSSQSLANSYGNTFLS

SEQ ID NO: 58 - protein, 7 aa, Artificial Sequence
  source: /note="Description of Artificial Sequence: Synthetic peptide"
GISNRFS

SEQ ID NO: 59 - protein, 9 aa, Artificial Sequence
  source: /note="Description of Artificial Sequence: Synthetic peptide"
LQGTHQPYT

SEQ ID NO: 60 - protein, 10 aa, Artificial Sequence
  source: /note="Description of Artificial Sequence: Synthetic peptide"
GFAFSIYDMS

SEQ ID NO: 61 - protein, 17 aa, Artificial Sequence
  source: /note="Description of Artificial Sequence: Synthetic peptide"
YISSGGGTTYYPDTVKG

SEQ ID NO: 62 - protein, 14 aa, Artificial Sequence
  source: /note="Description of Artificial Sequence: Synthetic peptide"
HSGYGTHWGVLFAY

SEQ ID NO: 63 - protein, 11 aa, Artificial Sequence
  source: /note="Description of Artificial Sequence: Synthetic peptide"
RASQDISNYLA

SEQ ID NO: 64 - protein, 7 aa, Artificial Sequence
  source: /note="Description of Artificial Sequence: Synthetic peptide"
YTSILHS

SEQ ID NO: 65 - protein, 9 aa, Artificial Sequence
  source: /note="Description of Artificial Sequence: Synthetic peptide"
QQGNTLPWT

SEQ ID NO: 66 - protein, 10 aa, Artificial Sequence
  source: /note="Description of Artificial Sequence: Synthetic peptide"
GYTFTDYYIT

SEQ ID NO: 67 - protein, 15 aa, Artificial Sequence
  source: /note="Description of Artificial Sequence: Synthetic peptide"
WIYPGSGNTKYNEKF

SEQ ID NO: 68 - protein, 8 aa, Artificial Sequence
  source: /note="Description of Artificial Sequence: Synthetic peptide"
YGNYWFAY

SEQ ID NO: 69 - protein, 15 aa, Artificial Sequence
  source: /note="Description of Artificial Sequence: Synthetic peptide"
KASQSVDFDGDSYMN

SEQ ID NO: 70 - protein, 7 aa, Artificial Sequence
  source: /note="Description of Artificial Sequence: Synthetic peptide"
AASNLES

SEQ ID NO: 71 - protein, 9 aa, Artificial Sequence
  source: /note="Description of Artificial Sequence: Synthetic peptide"
QQSNEDPWT

SEQ ID NO: 72 - protein, 9 aa, Artificial Sequence
  source: /note="Description of Artificial Sequence: Synthetic peptide"
YTFTTYWMH

SEQ ID NO: 73 - protein, 14 aa, Artificial Sequence
  source: /note="Description of Artificial Sequence: Synthetic peptide"
WIGYINPSTGYTDY

SEQ ID NO: 74 - protein, 16 aa, Artificial Sequence
  source: /note="Description of Artificial Sequence: Synthetic peptide"
TRRGPSYGNHGAWFPY

SEQ ID NO: 75 - protein, 8 aa, Artificial Sequence
  source: /note="Description of Artificial Sequence: Synthetic peptide"
ENVDTYVS

SEQ ID NO: 76 - protein, 11 aa, Artificial Sequence
  source: /note="Description of Artificial Sequence: Synthetic peptide"
LLIYGASNRYT

SEQ ID NO: 77 - protein, 8 aa, Artificial Sequence
  source: /note="Description of Artificial Sequence: Synthetic peptide"
GQSYRYPP

SEQ ID NO: 78 - protein, 10 aa, Artificial Sequence
  source: /note="Description of Artificial Sequence: Synthetic peptide"
GYTFTGYYMH

SEQ ID NO: 79 - protein, 15 aa, Artificial Sequence
  source: /note="Description of Artificial Sequence: Synthetic peptide"
WIDPNSGATTYAQKF

SEQ ID NO: 80 - protein, 11 aa, Artificial Sequence
  source: /note="Description of Artificial Sequence: Synthetic peptide"
KTTQTTWGFPF

SEQ ID NO: 81 - protein, 11 aa, Artificial Sequence
  source: /note="Description of Artificial Sequence: Synthetic peptide"
RASQGVYQWLA

SEQ ID NO: 82 - protein, 7 aa, Artificial Sequence
  source: /note="Description of Artificial Sequence: Synthetic peptide"
KASHLYN

SEQ ID NO: 83 - protein, 9 aa, Artificial Sequence
  source: /note="Description of Artificial Sequence: Synthetic peptide"
QQLNSYPLT

SEQ ID NO: 84 - protein, 10 aa, Artificial Sequence
  source: /note="Description of Artificial Sequence: Synthetic peptide"
GYTFTDYWMH

SEQ ID NO: 85 - protein, 14 aa, Artificial Sequence
  source: /note="Description of Artificial Sequence: Synthetic peptide"
WIGYINPNTAYTDY

SEQ ID NO: 86 - protein, 11 aa, Artificial Sequence
  source: /note="Description of Artificial Sequence: Synthetic peptide"
KASENVDSFVS

SEQ ID NO: 87 - protein, 7 aa, Artificial Sequence
  source: /note="Description of Artificial Sequence: Synthetic peptide"
GASNRYT

SEQ ID NO: 88 - protein, 9 aa, Artificial Sequence
  source: /note="Description of Artificial Sequence: Synthetic peptide"
GQNYRYPLT

SEQ ID NO: 89 - protein, 9 aa, Artificial Sequence
  source: /note="Description of Artificial Sequence: Synthetic peptide"
FSLISYGVH

SEQ ID NO: 90 - protein, 13 aa, Artificial Sequence
  source: /note="Description of Artificial Sequence: Synthetic peptide"
WLGVIWRGGSTDY

SEQ ID NO: 91 - protein, 12 aa, Artificial Sequence
  source: /note="Description of Artificial Sequence: Synthetic peptide"
KTLITTGYAMDY

SEQ ID NO: 92 - protein, 8 aa, Artificial Sequence
  source: /note="Description of Artificial Sequence: Synthetic peptide"
EDIYNRLA

SEQ ID NO: 93 - protein, 12 aa, Artificial Sequence
  source: /note="Description of Artificial Sequence: Synthetic peptide"
LLISGATSLETG

SEQ ID NO: 94 - protein, 7 aa, Artificial Sequence
  source: /note="Description of Artificial Sequence: Synthetic peptide"
QQYWSTP

SEQ ID NO: 95 - protein, 9 aa, Artificial Sequence
  source: /note="Description of Artificial Sequence: Synthetic peptide"
FTFNSFAMS

SEQ ID NO: 96 - protein, 14 aa, Artificial Sequence
  source: /note="Description of Artificial Sequence: Synthetic peptide"
WVSAISGSGGGTYY

SEQ ID NO: 97 - protein, 14 aa, Artificial Sequence
  source: /note="Description of Artificial Sequence: Synthetic peptide"
KDKILWFGEPVFDY

SEQ ID NO: 98 - protein, 8 aa, Artificial Sequence
  source: /note="Description of Artificial Sequence: Synthetic peptide"
QSVSSYLA

SEQ ID NO: 99 - protein, 11 aa, Artificial Sequence
  source: /note="Description of Artificial Sequence: Synthetic peptide"
LLIYDASNRAT

SEQ ID NO: 100 - protein, 8 aa, Artificial Sequence
  source: /note="Description of Artificial Sequence: Synthetic peptide"
QQRSNWPP

SEQ ID NO: 101 - protein, 9 aa, Artificial Sequence
  source: /note="Description of Artificial Sequence: Synthetic peptide"
FSLTSYGVH

SEQ ID NO: 102 - protein, 13 aa, Artificial Sequence
  source: /note="Description of Artificial Sequence: Synthetic peptide"
WIGVMWRGGSTDY

SEQ ID NO: 103 - protein, 12 aa, Artificial Sequence
  source: /note="Description of Artificial Sequence: Synthetic peptide"
KSMITTGFVMDS

SEQ ID NO: 104 - protein, 8 aa, Artificial Sequence
  source: /note="Description of Artificial Sequence: Synthetic peptide"
EDIYNRLT

SEQ ID NO: 105 - protein, 11 aa, Artificial Sequence
  source: /note="Description of Artificial Sequence: Synthetic peptide"
LLISGATSLET

SEQ ID NO: 106 - protein, 8 aa, Artificial Sequence
  source: /note="Description of Artificial Sequence: Synthetic peptide"
QQYWSNPY

SEQ ID NO: 107 - protein, 9 aa, Artificial Sequence
  source: /note="Description of Artificial Sequence: Synthetic peptide"
FDFSRSWMN

SEQ ID NO: 108 - protein, 14 aa, Artificial Sequence
  source: /note="Description of Artificial Sequence: Synthetic peptide"
WIGEINPDSSTINY

SEQ ID NO: 109 - protein, 8 aa, Artificial Sequence
  source: /note="Description of Artificial Sequence: Synthetic peptide"
RYGNWFPY

SEQ ID NO: 110 - protein, 8 aa, Artificial Sequence
  source: /note="Description of Artificial Sequence: Synthetic peptide"
QNVDTNVA

SEQ ID NO: 111 - protein, 11 aa, Artificial Sequence
  source: /note="Description of Artificial Sequence: Synthetic peptide"
ALIYSASYRYS

SEQ ID NO: 112 - protein, 8 aa, Artificial Sequence
  source: /note="Description of Artificial Sequence: Synthetic peptide"
QQYDSYPL

SEQ ID NO: 113 - protein, 9 aa, Artificial Sequence
  source: /note="Description of Artificial Sequence: Synthetic peptide"
GTFSSYAFS

SEQ ID NO: 114 - protein, 14 aa, Artificial Sequence
  source: /note="Description of Artificial Sequence: Synthetic peptide"
WMGRVIPFLGIANS

SEQ ID NO: 115 - protein, 12 aa, Artificial Sequence
  source: /note="Description of Artificial Sequence: Synthetic peptide"
RDDIAALGPFDY

SEQ ID NO: 116 - protein, 8 aa, Artificial Sequence
  source: /note="Description of Artificial Sequence: Synthetic peptide"
QGISSWLA

SEQ ID NO: 117 - protein, 11 aa, Artificial Sequence
  source: /note="Description of Artificial Sequence: Synthetic peptide"
SLIYAASSLQS

SEQ ID NO: 118 - protein, 8 aa, Artificial Sequence
  source: /note="Description of Artificial Sequence: Synthetic peptide"
QQYNSYPR

SEQ ID NO: 119 - protein, 9 aa, Artificial Sequence
  source: /note="Description of Artificial Sequence: Synthetic peptide"
YTFTDYWMQ

SEQ ID NO: 120 - protein, 14 aa, Artificial Sequence
  source: /note="Description of Artificial Sequence: Synthetic peptide"
WIGTIYPGDGDTGY

SEQ ID NO: 121 - protein, 12 aa, Artificial Sequence
  source: /note="Description of Artificial Sequence: Synthetic peptide"
RGDYYGSNSLDY

SEQ ID NO: 122 - protein, 8 aa, Artificial Sequence
  source: /note="Description of Artificial Sequence: Synthetic peptide"
QDVSTVVA

SEQ ID NO: 123 - protein, 11 aa, Artificial Sequence
  source: /note="Description of Artificial Sequence: Synthetic peptide"
RLIYSASYRYI

SEQ ID NO: 124 - protein, 8 aa, Artificial Sequence
  source: /note="Description of Artificial Sequence: Synthetic peptide"
QQHYSPPY

SEQ ID NO: 125 - protein, 10 aa, Artificial Sequence
  source: /note="Description of Artificial Sequence: Synthetic peptide"
GFSLTSYGVH

SEQ ID NO: 126 - protein, 16 aa, Artificial Sequence
  source: /note="Description of Artificial Sequence: Synthetic peptide"
VMWRGGSTDYNAAFMS

SEQ ID NO: 127 - protein, 11 aa, Artificial Sequence
  source: /note="Description of Artificial Sequence: Synthetic peptide"
SMITTGFVMDS

SEQ ID NO: 128 - protein, 11 aa, Artificial Sequence
  source: /note="Description of Artificial Sequence: Synthetic peptide"
KASEDIYNRLT

SEQ ID NO: 129 - protein, 7 aa, Artificial Sequence
  source: /note="Description of Artificial Sequence: Synthetic peptide"
GATSLET

SEQ ID NO: 130 - protein, 9 aa, Artificial Sequence
  source: /note="Description of Artificial Sequence: Synthetic peptide"
QQYWSNPYT

SEQ ID NO: 131 - protein, 10 aa, Artificial Sequence
  source: /note="Description of Artificial Sequence: Synthetic peptide"
GFSLISYGVH

SEQ ID NO: 132 - protein, 16 aa, Artificial Sequence
  source: /note="Description of Artificial Sequence: Synthetic peptide"
VIWRGGSTDYNAAFMS

SEQ ID NO: 133 - protein, 11 aa, Artificial Sequence
  source: /note="Description of Artificial Sequence: Synthetic peptide"
TLITTGYAMDY

SEQ ID NO: 134 - protein, 11 aa, Artificial Sequence
  source: /note="Description of Artificial Sequence: Synthetic peptide"
KASEDIYNRLA

SEQ ID NO: 135 - protein, 7 aa, Artificial Sequence
  source: /note="Description of Artificial Sequence: Synthetic peptide"
GATSLET

SEQ ID NO: 136 - protein, 8 aa, Artificial Sequence
  source: /note="Description of Artificial Sequence: Synthetic peptide"
QQYWSTPT

SEQ ID NO: 137 - protein, 10 aa, Artificial Sequence
  source: /note="Description of Artificial Sequence: Synthetic peptide"
GFDFSRSWMN

SEQ ID NO: 138 - protein, 17 aa, Artificial Sequence
  source: /note="Description of Artificial Sequence: Synthetic peptide"
EINPDSSTINYTTSLKD

SEQ ID NO: 139 - protein, 7 aa, Artificial Sequence
  source: /note="Description of Artificial Sequence: Synthetic peptide"
YGNWFPY

SEQ ID NO: 140 - protein, 11 aa, Artificial Sequence
  source: /note="Description of Artificial Sequence: Synthetic peptide"
KASQNVDTNVA

SEQ ID NO: 141 - protein, 7 aa, Artificial Sequence
  source: /note="Description of Artificial Sequence: Synthetic peptide"
SASYRYS

SEQ ID NO: 142 - protein, 9 aa, Artificial Sequence
  source: /note="Description of Artificial Sequence: Synthetic peptide"
QQYDSYPLT

SEQ ID NO: 143 - protein, 9 aa, Artificial Sequence
  source: /note="Description of Artificial Sequence: Synthetic peptide"
FDFSRYWMS

SEQ ID NO: 144 - protein, 14 aa, Artificial Sequence
  source: /note="Description of Artificial Sequence: Synthetic peptide"
WIGEINPTSSTINF

SEQ ID NO: 145 - protein, 13 aa, Artificial Sequence
  source: /note="Description of Artificial Sequence: Synthetic peptide"
RGNYYRYGDAMDY

SEQ ID NO: 146 - protein, 12 aa, Artificial Sequence
  source: /note="Description of Artificial Sequence: Synthetic peptide"
KSVSTSGYSYLH

SEQ ID NO: 147 - protein, 11 aa, Artificial Sequence
  source: /note="Description of Artificial Sequence: Synthetic peptide"
LLIYLASNLES

SEQ ID NO: 148 - protein, 8 aa, Artificial Sequence
  source: /note="Description of Artificial Sequence: Synthetic peptide"
QHSRELPF

SEQ ID NO: 149 - protein, 9 aa, Artificial Sequence
  source: /note="Description of Artificial Sequence: Synthetic peptide"
STFTTYWIH

SEQ ID NO: 150 - protein, 14 aa, Artificial Sequence
  source: /note="Description of Artificial Sequence: Synthetic peptide"
WIGYINPNTGYTEY

SEQ ID NO: 151 - protein, 9 aa, Artificial Sequence
  source: /note="Description of Artificial Sequence: Synthetic peptide"
VRFITVVGG

SEQ ID NO: 152 - protein, 9 aa, Artificial Sequence
  source: /note="Description of Artificial Sequence: Synthetic peptide"
SSVSSSHLH

SEQ ID NO: 153 - protein, 11 aa, Artificial Sequence
  source: /note="Description of Artificial Sequence: Synthetic peptide"
LWIYSTSNLAS

SEQ ID NO: 154 - protein, 8 aa, Artificial Sequence
  source: /note="Description of Artificial Sequence: Synthetic peptide"
HQYHRSPL

SEQ ID NO: 155 - protein, 11 aa, Artificial Sequence
  source: /note="Description of Artificial Sequence: Synthetic peptide"
FSLTTYGIGVG

SEQ ID NO: 156 - protein, 13 aa, Artificial Sequence
  source: /note="Description of Artificial Sequence: Synthetic peptide"
WLTHIWWNDNKYY

SEQ ID NO: 157 - protein, 5 aa, Artificial Sequence
  source: /note="Description of Artificial Sequence: Synthetic peptide"
YGYTY

SEQ ID NO: 158 - protein, 13 aa, Artificial Sequence
  source: /note="Description of Artificial Sequence: Synthetic peptide"
QSLLYSNGNTYLH

SEQ ID NO: 159 - protein, 11 aa, Artificial Sequence
  source: /note="Description of Artificial Sequence: Synthetic peptide"
LLIYKLSNRFS

SEQ ID NO: 160 - protein, 8 aa, Artificial Sequence
  source: /note="Description of Artificial Sequence: Synthetic peptide"
SQSTHVPW

SEQ ID NO: 161 - protein, 9 aa, Artificial Sequence
  source: /note="Description of Artificial Sequence: Synthetic peptide"
FNIKDTYIH

SEQ ID NO: 162 - protein, 14 aa, Artificial Sequence
  source: /note="Description of Artificial Sequence: Synthetic peptide"
WVARIYPTNGYTRY

SEQ ID NO: 163 - protein, 12 aa, Artificial Sequence
  source: /note="Description of Artificial Sequence: Synthetic peptide"
RWGGDGFYAMDY

SEQ ID NO: 164 - protein, 8 aa, Artificial Sequence
  source: /note="Description of Artificial Sequence: Synthetic peptide"
QDVNTAVA

SEQ ID NO: 165 - protein, 11 aa, Artificial Sequence
  source: /note="Description of Artificial Sequence: Synthetic peptide"
LLIYSASFLYS

SEQ ID NO: 166 - protein, 8 aa, Artificial Sequence
  source: /note="Description of Artificial Sequence: Synthetic peptide"
QQHYTTPP

SEQ ID NO: 167 - protein, 12 aa, Artificial Sequence
  source: /note="Description of Artificial Sequence: Synthetic peptide"
RWGGDGFYAMDV

SEQ ID NO: 168 - protein, 9 aa, Artificial Sequence
  source: /note="Description of Artificial Sequence: Synthetic peptide"
YSFTSYWIA

SEQ ID NO: 169 - protein, 14 aa, Artificial Sequence
  source: /note="Description of Artificial Sequence: Synthetic peptide"
YMGLIYPGDSDTKY

SEQ ID NO: 170 - protein, 21 aa, Artificial Sequence
  source: /note="Description of Artificial Sequence: Synthetic peptide"
RHDVGYCSSSNCAKWPEYFQH

SEQ ID NO: 171 - protein, 10 aa, Artificial Sequence
  source: /note="Description of Artificial Sequence: Synthetic peptide"
SSNIGNNYVS

SEQ ID NO: 172 - protein, 11 aa, Artificial Sequence
  source: /note="Description of Artificial Sequence: Synthetic peptide"
LLIYGHTNRPA

SEQ ID NO: 173 - protein, 10 aa, Artificial Sequence
  source: /note="Description of Artificial Sequence: Synthetic peptide"
AAWDDSLSGW

SEQ ID NO: 174 - protein, 9 aa, Artificial Sequence
  source: /note="Description of Artificial Sequence: Synthetic peptide"
YPFTNYGMN

SEQ ID NO: 175 - protein, 14 aa, Artificial Sequence
  source: /note="Description of Artificial Sequence: Synthetic peptide"
WMGWINTSTGESTF

SEQ ID NO: 176 - protein, 11 aa, Artificial Sequence
  source: /note="Description of Artificial Sequence: Synthetic peptide"
RWEVYHGYVPY

SEQ ID NO: 177 - protein, 8 aa, Artificial Sequence
  source: /note="Description of Artificial Sequence: Synthetic peptide"
QDVYNAVA

SEQ ID NO: 178 - protein, 11 aa, Artificial Sequence
  source: /note="Description of Artificial Sequence: Synthetic peptide"
LLIYSASSRYT

SEQ ID NO: 179 - protein, 8 aa, Artificial Sequence
  source: /note="Description of Artificial Sequence: Synthetic peptide"
QQHFRTPF

SEQ ID NO: 180 - protein, 9 aa, Artificial Sequence
  source: /note="Description of Artificial Sequence: Synthetic peptide"
ITFSINTMG

SEQ ID NO: 181 - protein, 14 aa, Artificial Sequence
  source: /note="Description of Artificial Sequence: Synthetic peptide"
LVALISSIGDTYYA

SEQ ID NO: 182 - protein, 12 aa, Artificial Sequence
  source: /note="Description of Artificial Sequence: Synthetic peptide"
KRFRTAAQGTDY

SEQ ID NO: 183 - protein, 10 aa, Artificial Sequence
  source: /note="Description of Artificial Sequence: Synthetic peptide"
GFNIKDTYIH

SEQ ID NO: 184 - protein, 17 aa, Artificial Sequence
  source: /note="Description of Artificial Sequence: Synthetic peptide"
RIYPTNGYTRYADSVKG

SEQ ID NO: 185 - protein, 11 aa, Artificial Sequence
  source: /note="Description of Artificial Sequence: Synthetic peptide"
WGGDGFYAMDY

SEQ ID NO: 186 - protein, 11 aa, Artificial Sequence
  source: /note="Description of Artificial Sequence: Synthetic peptide"
RASQDVNTAVA

SEQ ID NO: 187 - protein, 7 aa, Artificial Sequence
  source: /note="Description of Artificial Sequence: Synthetic peptide"
SASFLYS

SEQ ID NO: 188 - protein, 9 aa, Artificial Sequence
  source: /note="Description of Artificial Sequence: Synthetic peptide"
QQHYTTPPT

SEQ ID NO: 189 - protein, 10 aa, Artificial Sequence
  source: /note="Description of Artificial Sequence: Synthetic peptide"
GFNIKDTYIH

SEQ ID NO: 190 - protein, 17 aa, Artificial Sequence
  source: /note="Description of Artificial Sequence: Synthetic peptide"
RIYPTNGYTRYADSVKG

SEQ ID NO: 191 - protein, 11 aa, Artificial Sequence
  source: /note="Description of Artificial Sequence: Synthetic peptide"
WGGDGFYAMDV

SEQ ID NO: 192 - protein, 11 aa, Artificial Sequence
  source: /note="Description of Artificial Sequence: Synthetic peptide"
RASQDVNTAVA

SEQ ID NO: 193 - protein, 7 aa, Artificial Sequence
  source: /note="Description of Artificial Sequence: Synthetic peptide"
SASFLYS

SEQ ID NO: 194 - protein, 9 aa, Artificial Sequence
  source: /note="Description of Artificial Sequence: Synthetic peptide"
QQHYTTPPT

SEQ ID NO: 195 - protein, 10 aa, Artificial Sequence
  source: /note="Description of Artificial Sequence: Synthetic peptide"
GYSFTSYWIA

SEQ ID NO: 196 - protein, 17 aa, Artificial Sequence
  source: /note="Description of Artificial Sequence: Synthetic peptide"
LIYPGDSDTKYSPSFQG

SEQ ID NO: 197 - protein, 20 aa, Artificial Sequence
  source: /note="Description of Artificial Sequence: Synthetic peptide"
HDVGYCSSSNCAKWPEYFQH

SEQ ID NO: 198 - protein, 13 aa, Artificial Sequence
  source: /note="Description of Artificial Sequence: Synthetic peptide"
SGSSSNIGNNYVS

SEQ ID NO: 199 - protein, 7 aa, Artificial Sequence
  source: /note="Description of Artificial Sequence: Synthetic peptide"
GHTNRPA

SEQ ID NO: 200 - protein, 11 aa, Artificial Sequence
  source: /note="Description of Artificial Sequence: Synthetic peptide"
AAWDDSLSGWV

SEQ ID NO: 201 - protein, 10 aa, Artificial Sequence
  source: /note="Description of Artificial Sequence: Synthetic peptide"
GITFSINTMG

SEQ ID NO: 202 - protein, 16 aa, Artificial Sequence
  source: /note="Description of Artificial Sequence: Synthetic peptide"
LISSIGDTYYADSVKG

SEQ ID NO: 203 - protein, 10 aa, Artificial Sequence
  source: /note="Description of Artificial Sequence: Synthetic peptide"
FRTAAQGTDY

SEQ ID NO: 204 - protein, 9 aa, Artificial Sequence
  source: /note="Description of Artificial Sequence: Synthetic peptide"
FTFSDSWIH

SEQ ID NO: 205 - protein, 14 aa, Artificial Sequence
  source: /note="Description of Artificial Sequence: Synthetic peptide"
WVAWISPYGGSTYY

SEQ ID NO: 206 - protein, 10 aa, Artificial Sequence
  source: /note="Description of Artificial Sequence: Synthetic peptide"
RRHWPGGFDY

SEQ ID NO: 207 - protein, 8 aa, Artificial Sequence
  source: /note="Description of Artificial Sequence: Synthetic peptide"
QDVSTAVA

SEQ ID NO: 208 - protein, 11 aa, Artificial Sequence
  source: /note="Description of Artificial Sequence: Synthetic peptide"
LLIYSASFLYS

SEQ ID NO: 209 - protein, 8 aa, Artificial Sequence
  source: /note="Description of Artificial Sequence: Synthetic peptide"
QQYLYHPA

SEQ ID NO: 210 - protein, 9 aa, Artificial Sequence
  source: /note="Description of Artificial Sequence: Synthetic peptide"
YTFTSYVMH

SEQ ID NO: 211 - protein, 14 aa, Artificial Sequence
  source: /note="Description of Artificial Sequence: Synthetic peptide"
WIGYVNPFNDGTKY

SEQ ID NO: 212 - protein, 7 aa, Artificial Sequence
  source: /note="Description of Artificial Sequence: Synthetic peptide"
RQAWGYP

SEQ ID NO: 213 - protein, 12 aa, Artificial Sequence
  source: /note="Description of Artificial Sequence: Synthetic peptide"
ESVEYYGTSLVQ

SEQ ID NO: 214 - protein, 11 aa, Artificial Sequence
  source: /note="Description of Artificial Sequence: Synthetic peptide"
LLIYAASSVDS

SEQ ID NO: 215 - protein, 8 aa, Artificial Sequence
  source: /note="Description of Artificial Sequence: Synthetic peptide"
QQSRRVPY

SEQ ID NO: 216 - protein, 9 aa, Artificial Sequence
  source: /note="Description of Artificial Sequence: Synthetic peptide"
YTFTSYDVH

SEQ ID NO: 217 - protein, 14 aa, Artificial Sequence
  source: /note="Description of Artificial Sequence: Synthetic peptide"
WMGWLHADTGITKF

SEQ ID NO: 218 - protein, 10 aa, Artificial Sequence
  source: /note="Description of Artificial Sequence: Synthetic peptide"
RERIQLWFDY

SEQ ID NO: 219 - protein, 8 aa, Artificial Sequence
  source: /note="Description of Artificial Sequence: Synthetic peptide"
QGISSWLA

SEQ ID NO: 220 - protein, 11 aa, Artificial Sequence
  source: /note="Description of Artificial Sequence: Synthetic peptide"
SLIYAASSLQS

SEQ ID NO: 221 - protein, 8 aa, Artificial Sequence
  source: /note="Description of Artificial Sequence: Synthetic peptide"
QQYNSYPY

SEQ ID NO: 222 - protein, 9 aa, Artificial Sequence
  source: /note="Description of Artificial Sequence: Synthetic peptide"
DTFSTYAIS

SEQ ID NO: 223 - protein, 14 aa, Artificial Sequence
  source: /note="Description of Artificial Sequence: Synthetic peptide"
WMGGIIPIFGKAHY

SEQ ID NO: 224 - protein, 15 aa, Artificial Sequence
  source: /note="Description of Artificial Sequence: Synthetic peptide"
RKFHFVSGSPFGMDV

SEQ ID NO: 225 - protein, 8 aa, Artificial Sequence
  source: /note="Description of Artificial Sequence: Synthetic peptide"
QSVSSYLA

SEQ ID NO: 226 - protein, 11 aa, Artificial Sequence
  source: /note="Description of Artificial Sequence: Synthetic peptide"
LLIYDASNRAT

SEQ ID NO: 227 - protein, 7 aa, Artificial Sequence
  source: /note="Description of Artificial Sequence: Synthetic peptide"
QQRSNWP

SEQ ID NO: 228 - protein, 9 aa, Artificial Sequence
  source: /note="Description of Artificial Sequence: Synthetic peptide"
FTFSSYIMM

SEQ ID NO: 229 - protein, 14 aa, Artificial Sequence
  source: /note="Description of Artificial Sequence: Synthetic peptide"
WVSSIYPSGGITFY

SEQ ID NO: 230 - protein, 12 aa, Artificial Sequence
  source: /note="Description of Artificial Sequence: Synthetic peptide"
RIKLGTVTTVDY

SEQ ID NO: 231 - protein, 11 aa, Artificial Sequence
  source: /note="Description of Artificial Sequence: Synthetic peptide"
SSDVGGYNYVS

SEQ ID NO: 232 - protein, 11 aa, Artificial Sequence
  source: /note="Description of Artificial Sequence: Synthetic peptide"
LMIYDVSNRPS

SEQ ID NO: 233 - protein, 9 aa, Artificial Sequence
  source: /note="Description of Artificial Sequence: Synthetic peptide"
SSYTSSSTR

SEQ ID NO: 234 - protein, 10 aa, Artificial Sequence
  source: /note="Description of Artificial Sequence: Synthetic peptide"
GFNIKDYFLH

SEQ ID NO: 235 - protein, 17 aa, Artificial Sequence
  source: /note="Description of Artificial Sequence: Synthetic peptide"
WINPDNGNTVYDPKFQG

SEQ ID NO: 236 - protein, 12 aa, Artificial Sequence
  source: /note="Description of Artificial Sequence: Synthetic peptide"
RDYTYEKAALDY

SEQ ID NO: 237 - protein, 11 aa, Artificial Sequence
  source: /note="Description of Artificial Sequence: Synthetic peptide"
RASGNIYNYLA

SEQ ID NO: 238 - protein, 7 aa, Artificial Sequence
  source: /note="Description of Artificial Sequence: Synthetic peptide"
DAKTLAD

SEQ ID NO: 239 - protein, 9 aa, Artificial Sequence
  source: /note="Description of Artificial Sequence: Synthetic peptide"
QHFWSLPFT

SEQ ID NO: 240 - protein, 9 aa, Artificial Sequence
  source: /note="Description of Artificial Sequence: Synthetic peptide"
YTFTSYVMH

SEQ ID NO: 241 - protein, 15 aa, Artificial Sequence
  source: /note="Description of Artificial Sequence: Synthetic peptide"
YVNPFNDGTKYNEMF

SEQ ID NO: 242 - protein, 6 aa, Artificial Sequence
  source: /note="Description of Artificial Sequence: Synthetic peptide"
QAWGYP

SEQ ID NO: 243 - protein, 15 aa, Artificial Sequence
  source: /note="Description of Artificial Sequence: Synthetic peptide"
RATESVEYYGTSLVQ

SEQ ID NO: 244 - protein, 7 aa, Artificial Sequence
  source: /note="Description of Artificial Sequence: Synthetic peptide"
AASSVDS

SEQ ID NO: 245 - protein, 9 aa, Artificial Sequence
  source: /note="Description of Artificial Sequence: Synthetic peptide"
QQSRRVPYT

SEQ ID NO: 246 - protein, 16 aa, Artificial Sequence
  source: /note="Description of Artificial Sequence: Synthetic peptide"
EFPKPSTPPGSSGGAP

SEQ ID NO: 247 - protein, 25 aa, Artificial Sequence
  source: /note="Description of Artificial Sequence: Synthetic peptide"
EFPKPSTPPGSSGGAPGILGFVFTL

SEQ ID NO: 248 - protein, 7 aa, Artificial Sequence
  source: /note="Description of Artificial Sequence: Synthetic peptide"
GGGGSGG

SEQ ID NO: 249 - protein, 25 aa, Artificial Sequence
  source: /note="Description of Artificial Sequence: Synthetic peptide"
GGGGSGGGGSGGGGSGGGGSGGGGS

SEQ ID NO: 250 - protein, 15 aa, Artificial Sequence
  source: /note="Description of Artificial Sequence: Synthetic peptide"
GSTSGSGKPGSGEGS

SEQ ID NO: 251 - protein, 5 aa, Artificial Sequence
  source: /note="Description of Artificial Sequence: Synthetic peptide"
GGGGS

SEQ ID NO: 252 - protein, 508 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 253 - protein, 549 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKNLVPMVATVRRNLVPMVATVRRNLVPMVATV

SEQ ID NO: 254 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSANLVPMVATV

SEQ ID NO: 255 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSANLVPMVATV

SEQ ID NO: 256 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 257 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 258 - protein, 500 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 259 - protein, 508 aa, Artificial Sequence
  source: /note="Description of Artificial Sequence: Synthetic polypeptide"
MVTEHDTLLYKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 260 - protein, 508 aa, Artificial Sequence
  source: /note="Description of Artificial Sequence: Synthetic polypeptide"
MGLDRNSGNYKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 261 - protein, 507 aa, Artificial Sequence
  source: /note="Description of Artificial Sequence: Synthetic polypeptide"
MGVMTRGRLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 262 - protein, 508 aa, Artificial Sequence
  source: /note="Description of Artificial Sequence: Synthetic polypeptide"
MVYALPLKMLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 263 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSVTEHDTLLY

SEQ ID NO: 264 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSQYDPVAALF

SEQ ID NO: 265 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSCLGGLLTMV

SEQ ID NO: 266 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSILRGSVAHK

SEQ ID NO: 267 - protein, 521 aa, Artificial Sequence
  source: /note="Description of Artificial Sequence: Synthetic polypeptide"
MNLVPMVATVKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 268 - protein, 521 aa, Artificial Sequence
  source: /note="Description of Artificial Sequence: Synthetic polypeptide"
MNLVPMVATVKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 269 - protein, 521 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 270 - protein, 521 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 271 - protein, 521 aa, Artificial Sequence
  source: /note="Description of Artificial Sequence: Synthetic polypeptide"
MGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 272 - protein, 521 aa, Artificial Sequence
  source: /note="Description of Artificial Sequence: Synthetic polypeptide"
MDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 273 - protein, 521 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 274 - protein, 509 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSNLVPMVATV

SEQ ID NO: 275 - protein, 527 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKGILGFVFTL

SEQ ID NO: 276 - protein, 527 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKGILGFVFTL

SEQ ID NO: 277 - protein, 507 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSNLVPMVATV

SEQ ID NO: 278 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 279 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 280 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 281 - protein, 512 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 282 - protein, 512 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 283 - protein, 500 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 284 - protein, 518 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 285 - protein, 518 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 286 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 287 - protein, 522 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPGILGFVFTLMQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 288 - protein, 507 aa, Artificial Sequence
  source: /note="Description of Artificial Sequence: Synthetic polypeptide"
VTEHDTLLYAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 289 - protein, 507 aa, Artificial Sequence
  source: /note="Description of Artificial Sequence: Synthetic polypeptide"
GLDRNSGNYAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 290 - protein, 506 aa, Artificial Sequence
  source: /note="Description of Artificial Sequence: Synthetic polypeptide"
GVMTRGRLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 291 - protein, 507 aa, Artificial Sequence
  source: /note="Description of Artificial Sequence: Synthetic polypeptide"
VYALPLKMLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 292 - protein, 520 aa, Artificial Sequence
  source: /note="Description of Artificial Sequence: Synthetic polypeptide"
NLVPMVATVAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 293 - protein, 519 aa, Artificial Sequence
  source: /note="Description of Artificial Sequence: Synthetic polypeptide"
GILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVS

SEQ ID NO: 294 - protein, 520 aa, Artificial Sequence
  source: /note="Description of Artificial Sequence: Synthetic polypeptide"
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 295 - protein, 520 aa, Artificial Sequence
  source: /note="Description of Artificial Sequence: Synthetic polypeptide"
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 296 - protein, 507 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSVTEHDTLLY

SEQ ID NO: 297 - protein, 507 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 298 - protein, 507 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSQYDPVAALF

SEQ ID NO: 299 - protein, 507 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSCLGGLLTMV

SEQ ID NO: 300 - protein, 507 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSILRGSVAHK

SEQ ID NO: 301 - protein, 520 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 302 - protein, 508 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSNLVPMVATV

SEQ ID NO: 303 - protein, 526 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKGILGFVFTL

SEQ ID NO: 304 - protein, 506 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSNLVPMVATV

SEQ ID NO: 305 - protein, 507 aa, Artificial Sequence; identical to SEQ ID NO: 297
  source: /note="Description of Artificial Sequence: Synthetic polypeptide"

SEQ ID NO: 306 - protein, 520 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKNLVPMVATV

SEQ ID NO: 307 - protein, 508 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKNLVPMVATV

SEQ ID NO: 308 - protein, 521 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKNLVPMVATV

SEQ ID NO: 309 - protein, 400 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDNLVPMVATV

SEQ ID NO: 310 - protein, 516 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSSNLVPMVATV

SEQ ID NO: 311 - protein, 393 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAAHHSEDPSSKAPKAPEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSNLVPMVATV

SEQ ID NO: 312 - protein, 373 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPASVSDVPRDLEVVAATPTSLLISWCRQRCADSYRITYGETGGNSPVQEFTVPGSWKTATISGLKPGVDYTITVYVVTHYYGWDRYSHPISINYRTGSNLVPMVATV

SEQ ID NO: 313 - protein, 374 aa, Artificial Sequence
  source: /note="Description of Artificial Sequence: Synthetic polypeptide"
ASVSDVPRDLEVVAATPTSLLISWCRQRCADSYRITYGETGGNSPVQEFTVPGSWKTATISGLKPGVDYTITVYVVTHYYGWDRYSHPISINYRTGSEFPKPSTPPGSSGGAPAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAANLVPMVATV

SEQ ID NO: 314 - protein, 409 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTNLVPMVATV

SEQ ID NO: 315 - protein, 498 aa, Artificial Sequence
  source: /note="Description of Artificial Sequence: Synthetic polypeptide"
NLVPMVATVAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAGGGGSGGDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 316 - protein, 520 aa, Artificial Sequence; identical to SEQ ID NO: 292
  source: /note="Description of Artificial Sequence: Synthetic polypeptide"

SEQ ID NO: 317 - protein, 508 aa, Artificial Sequence
  source: /note="Description of Artificial Sequence: Synthetic polypeptide"
NLVPMVATVAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 318 - protein, 526 aa, Artificial Sequence
  source: /note="Description of Artificial Sequence: Synthetic polypeptide"
GILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 319 - protein, 497 aa, Artificial Sequence
  source: /note="Description of Artificial Sequence: Synthetic polypeptide"
NLVPMVATVAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAGGGGSGGDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 320 - protein, 507 aa, Artificial Sequence
  source: /note="Description of Artificial Sequence: Synthetic polypeptide"
NLVPMVATVAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 321 - protein, 520 aa, Artificial Sequence
  source: /note="Description of Artificial Sequence: Synthetic polypeptide"
NLVPMVATVAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 322 - protein, 519 aa, Artificial Sequence
  source: /note="Description of Artificial Sequence: Synthetic polypeptide"
NLVPMVATVAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAGGGGSGGQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSGGGGSGGGGSGGGGSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELK

SEQ ID NO: 323 - protein, 409 aa, Artificial Sequence
  source: /note="Description of Artificial Sequence: Synthetic polypeptide"
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPNLVPMVATVAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 324 - protein, 409 aa, Artificial Sequence
  source: /note="Description of Artificial Sequence: Synthetic polypeptide"
GILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 325 - protein, 521 aa, Artificial Sequence
  source: /note="Description of Artificial Sequence: Synthetic polypeptide"
MNLVPMVATVAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 326 - protein, 521 aa, Artificial Sequence; identical to SEQ ID NO: 325
  source: /note="Description of Artificial Sequence: Synthetic polypeptide"

SEQ ID NO: 327 - protein, 521 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 328 - protein, 521 aa, Artificial Sequence; identical to SEQ ID NO: 327
  source: /note="Description of Artificial Sequence: Synthetic polypeptide"

SEQ ID NO: 329 - protein, 521 aa, Artificial Sequence
  source: /note="Description of Artificial Sequence: Synthetic polypeptide"
MGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 330 - protein, 521 aa, Artificial Sequence
  source: /note="Description of Artificial Sequence: Synthetic polypeptide"
MDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 331 - protein, 521 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 332 - protein, 509 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSNLVPMVATV

SEQ ID NO: 333 - protein, 527 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKGILGFVFTL

SEQ ID NO: 334 - protein, 527 aa, Artificial Sequence; identical to SEQ ID NO: 333
  source: /note="Description of Artificial Sequence: Synthetic polypeptide"

SEQ ID NO: 335 - protein, 507 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSNLVPMVATV

SEQ ID NO: 336 - protein, 508 aa, Artificial Sequence; identical to SEQ ID NO: 252
  source: /note="Description of Artificial Sequence: Synthetic polypeptide"

SEQ ID NO: 337 - protein, 520 aa, Artificial Sequence; identical to SEQ ID NO: 295
  source: /note="Description of Artificial Sequence: Synthetic polypeptide"

SEQ ID NO: 338 - protein, 521 aa, Artificial Sequence; identical to SEQ ID NO: 331
  source: /note="Description of Artificial Sequence: Synthetic polypeptide"

SEQ ID NO: 339 - protein, 525 aa, Artificial Sequence
  source: /note="Description of Artificial Sequence: Synthetic polypeptide"
MDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAKDEL

SEQ ID NO: 340 - protein, 525 aa, Artificial Sequence; identical to SEQ ID NO: 339
  source: /note="Description of Artificial Sequence: Synthetic polypeptide"

SEQ ID NO: 341 - protein, 521 aa, Artificial Sequence
  source: /note="Description of Artificial Sequence: Synthetic polypeptide"
MDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSSEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAKDEL

SEQ ID NO: 342 - protein, 521 aa, Artificial Sequence; identical to SEQ ID NO: 341
  source: /note="Description of Artificial Sequence: Synthetic polypeptide"

SEQ ID NO: 343 - protein, 530 aa, Artificial Sequence
  source: /note="Description of Artificial Sequence: Synthetic polypeptide"
MDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKGSTSGSGKPGSGEGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSAEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAKDEL

SEQ ID NO: 344 - protein, 530 aa, Artificial Sequence; identical to SEQ ID NO: 343
  source: /note="Description of Artificial Sequence: Synthetic polypeptide"

SEQ ID NO: 345 - protein, 531 aa, Artificial Sequence
  source: /note="Description of Artificial Sequence: Synthetic polypeptide"
MDIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKGSTSGSGKPGSGEGSTKGQVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSSEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAKDEL

SEQ ID NO: 346 - protein, 531 aa, Artificial Sequence; identical to SEQ ID NO: 345
  source: /note="Description of Artificial Sequence: Synthetic polypeptide"

SEQ ID NO: 347 - protein, 398 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDPSSKAPKAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAKDEL

SEQ ID NO: 348 - protein, 399 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAKDEL

SEQ ID NO: 349 - protein, 407 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDPSSKAPKAPGILGFVFTLGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAKDEL

SEQ ID NO: 350 - protein, 408 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSEFPKPSTPPGSSGGAPGILGFVFTLGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAKDEL

SEQ ID NO: 351 - protein, 414 aa, Artificial Sequence
  source: /note="Description of Artificial Sequence: Synthetic polypeptide"
MAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAKDEL

SEQ ID NO: 352 - protein, 414 aa, Artificial Sequence
  source: /note="Description of Artificial Sequence: Synthetic polypeptide"
MAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAKDEL

SEQ ID NO: 353 - protein, 519 aa, Artificial Sequence
  source: /note="Description of Artificial Sequence: Synthetic polypeptide"
MQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGSTSGSGKPGSGEGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 354 - protein, 521 aa, Artificial Sequence; identical to SEQ ID NO: 331
  source: /note="Description of Artificial Sequence: Synthetic polypeptide"

SEQ ID NO: 355 - protein, 521 aa, Artificial Sequence; identical to SEQ ID NO: 331
  source: /note="Description of Artificial Sequence: Synthetic polypeptide"

SEQ ID NO: 356 - protein, 521 aa, Artificial Sequence; identical to SEQ ID NO: 331
  source: /note="Description of Artificial Sequence: Synthetic polypeptide"

SEQ ID NO: 357 - protein, 522 aa, Artificial Sequence
  source: /note="Description of Artificial Sequence: Synthetic polypeptide"
MQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 358 - protein, 521 aa, Artificial Sequence
  source: /note="Description of Artificial Sequence: Synthetic polypeptide"
MEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGSTSGSGKPGSGEGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 359 - protein, 531 aa, Artificial Sequence
  source: /note="Description of Artificial Sequence: Synthetic polypeptide"
MEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 360 - protein, 530 aa, Artificial Sequence
  source: /note="Description of Artificial Sequence: Synthetic polypeptide"
MQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGGGSGGGGSGGGGSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSEFPKPSTPPGSSGGILGFVFTLGAPAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 361 - protein, 520 aa, Artificial Sequence
  source: /note="Description of Artificial Sequence: Synthetic polypeptide"
MQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGSTSGSGKPGSGEGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 362 - protein, 373 aa, Artificial Sequence
  source: /note="Description of Artificial Sequence: Synthetic polypeptide"
ASVSDVPRDLEVVAATPTSLLISWCRQRCADSYRITYGETGGNSPVQEFTVPGSWKTATISGLKPGVDYTITVYVVTHYYGWDRYSHPISINYRTGSEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 363 - protein, 781 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAACITGDALVALPEGESVRIADIVPGARPNSDNAIDLKVLDRHGNPVLADRLFHSGEHPVYTVRTVEGLRVTGTANHPLLCLVDVAGVPTLLWKLIDEIKPGDYAVIQRSAFSVDCAGFARGKPEFAPTTYTVGVPGLVRFLEAHHRDPDAQAIADELTDGRFYYAKVASVTDAGVQPVYSLRVDTADHAFITNGFVSHATGLTGLNSGLTTNPGVSAWQVNTAYTAGQLVTYNGKTYKCLQPHTSLAGWEPSNVPALWQLQ

SEQ ID NO: 364 - protein, 781 aa, Artificial Sequence; identical to SEQ ID NO: 363
  source: /note="Description of Artificial Sequence: Synthetic polypeptide"

SEQ ID NO: 365 - protein, 525 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAKDEL

SEQ ID NO: 366 - protein, 522 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPGILGFVFTLMQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 367 - protein, 517 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPGILGFVFTLDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSS

SEQ ID NO: 368 - protein, 517 aa, Artificial Sequence; identical to SEQ ID NO: 367
  source: /note="Description of Artificial Sequence: Synthetic polypeptide"

SEQ ID NO: 369 - protein, 521 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPGILGFVFTLDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSS

SEQ ID NO: 370 - protein, 521 aa, Artificial Sequence; identical to SEQ ID NO: 369
  source: /note="Description of Artificial Sequence: Synthetic polypeptide"

SEQ ID NO: 371 - protein, 525 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPGILGFVFTLDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKGSTSGSGKPGSGEGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSS

SEQ ID NO: 372 - protein, 525 aa, Artificial Sequence; identical to SEQ ID NO: 371
  source: /note="Description of Artificial Sequence: Synthetic polypeptide"

SEQ ID NO: 373 - protein, 527 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPGILGFVFTLDIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKGSTSGSGKPGSGEGSTKGQVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSS

SEQ ID NO: 374 - protein, 527 aa, Artificial Sequence; identical to SEQ ID NO: 373
  source: /note="Description of Artificial Sequence: Synthetic polypeptide"

SEQ ID NO: 375 - protein, 394 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAAHHSEDPSSKAPKAPGILGFVFTLEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSS

SEQ ID NO: 376 - protein, 395 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPGILGFVFTLEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSS

SEQ ID NO: 377 - protein, 394 aa, Artificial Sequence; identical to SEQ ID NO: 375
  source: /note="Description of Artificial Sequence: Synthetic polypeptide"

SEQ ID NO: 378 - protein, 395 aa, Artificial Sequence; identical to SEQ ID NO: 376
  source: /note="Description of Artificial Sequence: Synthetic polypeptide"

SEQ ID NO: 379 - protein, 374 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPGILGFVFTLASVSDVPRDLEVVAATPTSLLISWCRQRCADSYRITYGETGGNSPVQEFTVPGSWKTATISGLKPGVDYTITVYVVTHYYGWDRYSHPISINYRTGS

SEQ ID NO: 380 - protein, 374 aa, Artificial Sequence; identical to SEQ ID NO: 379
  source: /note="Description of Artificial Sequence: Synthetic polypeptide"

SEQ ID NO: 381 - protein, 507 aa, Artificial Sequence
  source: /note="Description of Artificial Sequence: Synthetic polypeptide"
VTEHDTLLYKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 382 - protein, 507 aa, Artificial Sequence
  source: /note="Description of Artificial Sequence: Synthetic polypeptide"
GLDRNSGNYKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 383 - protein, 506 aa, Artificial Sequence
  source: /note="Description of Artificial Sequence: Synthetic polypeptide"
GVMTRGRLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 384 - protein, 507 aa, Artificial Sequence
  source: /note="Description of Artificial Sequence: Synthetic polypeptide"
VYALPLKMLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 385 - protein, 520 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 386 - protein, 519 aa, Artificial Sequence; identical to SEQ ID NO: 293
  source: /note="Description of Artificial Sequence: Synthetic polypeptide"

SEQ ID NO: 387 - protein, 520 aa, Artificial Sequence
  source: /note="Description of Artificial Sequence: Synthetic polypeptide"
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 388 - protein, 520 aa, Artificial Sequence
  source: /note="Description of Artificial Sequence: Synthetic polypeptide"
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 389 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSVTEHDTLLY

SEQ ID NO: 390 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 391 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSQYDPVAALF

SEQ ID NO: 392 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSCLGGLLTMV

SEQ ID NO: 393 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSILRGSVAHK

SEQ ID NO: 394 - protein, 520 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 395 - protein, 508 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSNLVPMVATV

SEQ ID NO: 396 - protein, 526 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKGILGFVFTL

SEQ ID NO: 397 - protein, 506 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSNLVPMVATV

SEQ ID NO: 398 - protein, 507 aa, Artificial Sequence; identical to SEQ ID NO: 390
  source: /note="Description of Artificial Sequence: Synthetic polypeptide"

SEQ ID NO: 399 - protein, 520 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKNLVPMVATV

SEQ ID NO: 400 - protein, 508 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKNLVPMVATV

SEQ ID NO: 401 - protein, 521 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKNLVPMVATV

SEQ ID NO: 402 - protein, 400 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDNLVPMVATV

SEQ ID NO: 403 - protein, 516 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSSNLVPMVATV

SEQ ID NO: 404 - protein, 393 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAAHHSEDPSSKAPKAPEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSNLVPMVATV

SEQ ID NO: 405 - protein, 373 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPASVSDVPRDLEVVAATPTSLLISWCRQRCADSYRITYGETGGNSPVQEFTVPGSWKTATISGLKPGVDYTITVYVVTHYYGWDRYSHPISINYRTGSNLVPMVATV

SEQ ID NO: 406 - protein, 374 aa, Artificial Sequence
  source: /note="Description of Artificial Sequence: Synthetic polypeptide"
ASVSDVPRDLEVVAATPTSLLISWCRQRCADSYRITYGETGGNSPVQEFTVPGSWKTATISGLKPGVDYTITVYVVTHYYGWDRYSHPISINYRTGSEFPKPSTPPGSSGGAPKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAAANLVPMVATV

SEQ ID NO: 407 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSANLVPMVATV

SEQ ID NO: 408 - protein, 498 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAGGGGSGGDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 409 - protein, 520 aa, Artificial Sequence; identical to SEQ ID NO: 385
  source: /note="Description of Artificial Sequence: Synthetic polypeptide"

SEQ ID NO: 410 - protein, 508 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 411 - protein, 526 aa, Artificial Sequence
  source: /note="Description of Artificial Sequence: Synthetic polypeptide"
GILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 412 - protein, 497 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAGGGGSGGDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 413 - protein, 507 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 414 - protein, 520 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 415 - protein, 519 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAGGGGSGGQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSGGGGSGGGGSGGGGSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELK

SEQ ID NO: 416 - protein, 409 aa, Artificial Sequence
  source: /note="Description of Artificial Sequence: Synthetic polypeptide"
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPNLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 417 - protein, 409 aa, Artificial Sequence
  source: /note="Description of Artificial Sequence: Synthetic polypeptide"
GILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 418 - protein, 521 aa, Artificial Sequence
  source: /note="Description of Artificial Sequence: Synthetic polypeptide"
MNLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 419 - protein, 521 aa, Artificial Sequence; identical to SEQ ID NO: 418
  source: /note="Description of Artificial Sequence: Synthetic polypeptide"

SEQ ID NO: 420 - protein, 521 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 421 - protein, 521 aa, Artificial Sequence; identical to SEQ ID NO: 420
  source: /note="Description of Artificial Sequence: Synthetic polypeptide"

SEQ ID NO: 422 - protein, 521 aa, Artificial Sequence
  source: /note="Description of Artificial Sequence: Synthetic polypeptide"
MGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 423 - protein, 521 aa, Artificial Sequence
  source: /note="Description of Artificial Sequence: Synthetic polypeptide"
MDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 424 - protein, 521 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 425 - protein, 509 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSNLVPMVATV

SEQ ID NO: 426 - protein, 527 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKGILGFVFTL

SEQ ID NO: 427 - protein, 527 aa, Artificial Sequence; identical to SEQ ID NO: 426
  source: /note="Description of Artificial Sequence: Synthetic polypeptide"

SEQ ID NO: 428 - protein, 507 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSNLVPMVATV

SEQ ID NO: 429 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 430 - protein, 520 aa, Artificial Sequence; identical to SEQ ID NO: 388
  source: /note="Description of Artificial Sequence: Synthetic polypeptide"

SEQ ID NO: 431 - protein, 521 aa, Artificial Sequence; identical to SEQ ID NO: 424
  source: /note="Description of Artificial Sequence: Synthetic polypeptide"

SEQ ID NO: 432 - protein, 525 aa, Artificial Sequence
  source: /note="Description of Artificial Sequence: Synthetic polypeptide"
MDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 433 - protein, 525 aa, Artificial Sequence; identical to SEQ ID NO: 432
  source: /note="Description of Artificial Sequence: Synthetic polypeptide"

SEQ ID NO: 434 - protein, 521 aa, Artificial Sequence
  source: /note="Description of Artificial Sequence: Synthetic polypeptide"
MDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 435 - protein, 521 aa, Artificial Sequence; identical to SEQ ID NO: 434
  source: /note="Description of Artificial Sequence: Synthetic polypeptide"

SEQ ID NO: 436 - protein, 530 aa, Artificial Sequence
  source: /note="Description of Artificial Sequence: Synthetic polypeptide"
MDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKGSTSGSGKPGSGEGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSAEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 437 - protein, 530 aa, Artificial Sequence; identical to SEQ ID NO: 436
  source: /note="Description of Artificial Sequence: Synthetic polypeptide"

SEQ ID NO: 438 - protein, 531 aa, Artificial Sequence
  source: /note="Description of Artificial Sequence: Synthetic polypeptide"
MDIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKGSTSGSGKPGSGEGSTKGQVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 439 - protein, 531 aa, Artificial Sequence; identical to SEQ ID NO: 438
  source: /note="Description of Artificial Sequence: Synthetic polypeptide"

SEQ ID NO: 440 - protein, 398 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDPSSKAPKAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 441 - protein, 399 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 442 - protein, 407 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDPSSKAPKAPGILGFVFTLGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 443 - protein, 408 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSEFPKPSTPPGSSGGAPGILGFVFTLGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 444 - protein, 414 aa, Artificial Sequence
  source: /note="Description of Artificial Sequence: Synthetic polypeptide"
MAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 445 - protein, 414 aa, Artificial Sequence
  source: /note="Description of Artificial Sequence: Synthetic polypeptide"
MAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAAKDEL

SEQ ID NO: 446 - protein, 519 aa, Artificial Sequence
  source: /note="Description of Artificial Sequence: Synthetic polypeptide"
MQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGSTSGSGKPGSGEGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 447 - protein, 521 aa, Artificial Sequence; identical to SEQ ID NO: 424
  source: /note="Description of Artificial Sequence: Synthetic polypeptide"

SEQ ID NO: 448 - protein, 521 aa, Artificial Sequence; identical to SEQ ID NO: 424
  source: /note="Description of Artificial Sequence: Synthetic polypeptide"

SEQ ID NO: 449 - protein, 521 aa, Artificial Sequence; identical to SEQ ID NO: 424
  source: /note="Description of Artificial Sequence: Synthetic polypeptide"

SEQ ID NO: 450 - protein, 522 aa, Artificial Sequence
  source: /note="Description of Artificial Sequence: Synthetic polypeptide"
MQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 451 - protein, 521 aa, Artificial Sequence
  source: /note="Description of Artificial Sequence: Synthetic polypeptide"
MEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGSTSGSGKPGSGEGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 452 - protein, 531 aa, Artificial Sequence
  source: /note="Description of Artificial Sequence: Synthetic polypeptide"
MEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 453 - protein, 530 aa, Artificial Sequence
  source: /note="Description of Artificial Sequence: Synthetic polypeptide"
MQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGGGSGGGGSGGGGSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSEFPKPSTPPGSSGGILGFVFTLGAPKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 454 - protein, 520 aa, Artificial Sequence
  source: /note="Description of Artificial Sequence: Synthetic polypeptide"
MQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGSTSGSGKPGSGEGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 455 - protein, 373 aa, Artificial Sequence
  source: /note="Description of Artificial Sequence: Synthetic polypeptide"
ASVSDVPRDLEVVAATPTSLLISWCRQRCADSYRITYGETGGNSPVQEFTVPGSWKTATISGLKPGVDYTITVYVVTHYYGWDRYSHPISINYRTGSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 456 - protein, 781 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAACITGDALVALPEGESVRIADIVPGARPNSDNAIDLKVLDRHGNPVLADRLFHSGEHPVYTVRTVEGLRVTGTANHPLLCLVDVAGVPTLLWKLIDEIKPGDYAVIQRSAFSVDCAGFARGKPEFAPTTYTVGVPGLVRFLEAHHRDPDAQAIADELTDGRFYYAKVASVTDAGVQPVYSLRVDTADHAFITNGFVSHATGLTGLNSGLTTNPGVSAWQVNTAYTAGQLVTYNGKTYKCLQPHTSLAGWEPSNVPALWQLQ

SEQ ID NO: 457 - protein, 781 aa, Artificial Sequence; identical to SEQ ID NO: 456
  source: /note="Description of Artificial Sequence: Synthetic polypeptide"

SEQ ID NO: 458 - protein, 525 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 459 - protein, 522 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLMQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 460 - protein, 517 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSS

SEQ ID NO: 461 - protein, 517 aa, Artificial Sequence; identical to SEQ ID NO: 460
  source: /note="Description of Artificial Sequence: Synthetic polypeptide"

SEQ ID NO: 462 - protein, 521 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSS

SEQ ID NO: 463 - protein, 521 aa, Artificial Sequence; identical to SEQ ID NO: 462
  source: /note="Description of Artificial Sequence: Synthetic polypeptide"

SEQ ID NO: 464 - protein, 525 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKGSTSGSGKPGSGEGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSS

SEQ ID NO: 465 - protein, 525 aa, Artificial Sequence; identical to SEQ ID NO: 464
  source: /note="Description of Artificial Sequence: Synthetic polypeptide"

SEQ ID NO: 466 - protein, 527 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKGSTSGSGKPGSGEGSTKGQVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSS

SEQ ID NO: 467 - protein, 527 aa, Artificial Sequence; identical to SEQ ID NO: 466
  source: /note="Description of Artificial Sequence: Synthetic polypeptide"

SEQ ID NO: 468 - protein, 394 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAAHHSEDPSSKAPKAPGILGFVFTLEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSS

SEQ ID NO: 469 - protein, 395 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSS

SEQ ID NO: 470 - protein, 394 aa, Artificial Sequence; identical to SEQ ID NO: 468
  source: /note="Description of Artificial Sequence: Synthetic polypeptide"

SEQ ID NO: 471 - protein, 395 aa, Artificial Sequence; identical to SEQ ID NO: 469
  source: /note="Description of Artificial Sequence: Synthetic polypeptide"

SEQ ID NO: 472 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 473 - protein, 508 aa, Artificial Sequence; identical to SEQ ID NO: 472
  source: /note="Description of Artificial Sequence: Synthetic polypeptide"

SEQ ID NO: 474 - protein, 507 aa, Artificial Sequence
  source: /note="Description of Artificial Sequence: Synthetic polypeptide"
VTEHDTLLYKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 475 - protein, 507 aa, Artificial Sequence
  source: /note="Description of Artificial Sequence: Synthetic polypeptide"
GLDRNSGNYKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 476 - protein, 506 aa, Artificial Sequence
  source: /note="Description of Artificial Sequence: Synthetic polypeptide"
GVMTRGRLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 477 - protein, 507 aa, Artificial Sequence
  source: /note="Description of Artificial Sequence: Synthetic polypeptide"
VYALPLKMLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 478 - protein, 520 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 479 - protein, 519 aa, Artificial Sequence
  source: /note="Description of Artificial Sequence: Synthetic polypeptide"
GILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVS

SEQ ID NO: 480 - protein, 520 aa, Artificial Sequence
  source: /note="Description of Artificial Sequence: Synthetic polypeptide"
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 481 - protein, 520 aa, Artificial Sequence
  source: /note="Description of Artificial Sequence: Synthetic polypeptide"
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 482 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSVTEHDTLLY

SEQ ID NO: 483 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 484 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSQYDPVAALF

SEQ ID NO: 485 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSCLGGLLTMV

SEQ ID NO: 486 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSILRGSVAHK

SEQ ID NO: 487 - protein, 520 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 488 - protein, 508 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSNLVPMVATV

SEQ ID NO: 489 - protein, 526 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKGILGFVFTL

SEQ ID NO: 490 - protein, 506 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSNLVPMVATV

SEQ ID NO: 491 - protein, 507 aa, Artificial Sequence; identical to SEQ ID NO: 483
  source: /note="Description of Artificial Sequence: Synthetic polypeptide"

SEQ ID NO: 492 - protein, 520 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKNLVPMVATV

SEQ ID NO: 493 - protein, 508 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKNLVPMVATV

SEQ ID NO: 494 - protein, 521 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKNLVPMVATV

SEQ ID NO: 495 - protein, 400 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDNLVPMVATV

SEQ ID NO: 496 - protein, 516 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSSNLVPMVATV

SEQ ID NO: 497 - protein, 393 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAAHHSEDPSSKAPKAPEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSNLVPMVATV

SEQ ID NO: 498 - protein, 373 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAAEFPKPSTPPGSSGGAPASVSDVPRDLEVVAATPTSLLISWCRQRCADSYRITYGETGGNSPVQEFTVPGSWKTATISGLKPGVDYTITVYVVTHYYGWDRYSHPISINYRTGSNLVPMVATV

SEQ ID NO: 499 - protein, 374 aa, Artificial Sequence
  source: /note="Description of Artificial Sequence: Synthetic polypeptide"
ASVSDVPRDLEVVAATPTSLLISWCRQRCADSYRITYGETGGNSPVQEFTVPGSWKTATISGLKPGVDYTITVYVVTHYYGWDRYSHPISINYRTGSEFPKPSTPPGSSGGAPKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAANLVPMVATV

SEQ ID NO: 500 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSANLVPMVATV

SEQ ID NO: 501 - protein, 498 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAGGGGSGGDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 502 - protein, 520 aa, Artificial Sequence; identical to SEQ ID NO: 478
  source: /note="Description of Artificial Sequence: Synthetic polypeptide"

SEQ ID NO: 503 - protein, 508 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 504 - protein, 526 aa, Artificial Sequence
  source: /note="Description of Artificial Sequence: Synthetic polypeptide"
GILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 505 - protein, 497 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAGGGGSGGDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 506 - protein, 507 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 507 - protein, 520 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 508 - protein, 519 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAGGGGSGGQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSGGGGSGGGGSGGGGSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELK

SEQ ID NO: 509 - protein, 409 aa, Artificial Sequence
  source: /note="Description of Artificial Sequence: Synthetic polypeptide"
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPNLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 510 - protein, 409 aa, Artificial Sequence
  source: /note="Description of Artificial Sequence: Synthetic polypeptide"
GILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 511 - protein, 521 aa, Artificial Sequence
  source: /note="Description of Artificial Sequence: Synthetic polypeptide"
MNLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 512 - protein, 521 aa, Artificial Sequence; identical to SEQ ID NO: 511
  source: /note="Description of Artificial Sequence: Synthetic polypeptide"

SEQ ID NO: 513 - protein, 521 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 514 - protein, 521 aa, Artificial Sequence; identical to SEQ ID NO: 513
  source: /note="Description of Artificial Sequence: Synthetic polypeptide"

SEQ ID NO: 515 - protein, 521 aa, Artificial Sequence
  source: /note="Description of Artificial Sequence: Synthetic polypeptide"
MGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 516 - protein, 521 aa, Artificial Sequence
  source: /note="Description of Artificial Sequence: Synthetic polypeptide"
MDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 517 - protein, 521 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 518 - protein, 509 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSNLVPMVATV

SEQ ID NO: 519 - protein, 527 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKGILGFVFTL

SEQ ID NO: 520 - protein, 527 aa, Artificial Sequence; identical to SEQ ID NO: 519
  source: /note="Description of Artificial Sequence: Synthetic polypeptide"

SEQ ID NO: 521 - protein, 507 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSNLVPMVATV

SEQ ID NO: 522 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 523 - protein, 520 aa, Artificial Sequence; identical to SEQ ID NO: 481
  source: /note="Description of Artificial Sequence: Synthetic polypeptide"

SEQ ID NO: 524 - protein, 521 aa, Artificial Sequence; identical to SEQ ID NO: 517
  source: /note="Description of Artificial Sequence: Synthetic polypeptide"

SEQ ID NO: 525 - protein, 525 aa, Artificial Sequence
  source: /note="Description of Artificial Sequence: Synthetic polypeptide"
MDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 526 - protein, 525 aa, Artificial Sequence; identical to SEQ ID NO: 525
  source: /note="Description of Artificial Sequence: Synthetic polypeptide"

SEQ ID NO: 527 - protein, 521 aa, Artificial Sequence
  source: /note="Description of Artificial Sequence: Synthetic polypeptide"
MDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 528 - protein, 521 aa, Artificial Sequence; identical to SEQ ID NO: 527
  source: /note="Description of Artificial Sequence: Synthetic polypeptide"

SEQ ID NO: 529 - protein, 530 aa, Artificial Sequence
  source: /note="Description of Artificial Sequence: Synthetic polypeptide"
MDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKGSTSGSGKPGSGEGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSAEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 530 - protein, 530 aa, Artificial Sequence; identical to SEQ ID NO: 529
  source: /note="Description of Artificial Sequence: Synthetic polypeptide"

SEQ ID NO: 531 - protein, 531 aa, Artificial Sequence
  source: /note="Description of Artificial Sequence: Synthetic polypeptide"
MDIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKGSTSGSGKPGSGEGSTKGQVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 532 - protein, 531 aa, Artificial Sequence; identical to SEQ ID NO: 531
  source: /note="Description of Artificial Sequence: Synthetic polypeptide"

SEQ ID NO: 533 - protein, 398 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDPSSKAPKAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 534 - protein, 399 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 535 - protein, 407 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDPSSKAPKAPGILGFVFTLGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 536 - protein, 408 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSEFPKPSTPPGSSGGAPGILGFVFTLGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 537 - protein, 414 aa, Artificial Sequence
  source: /note="Description of Artificial Sequence: Synthetic polypeptide"
MAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 538 - protein, 414 aa, Artificial Sequence
  source: /note="Description of Artificial Sequence: Synthetic polypeptide"
MAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAAKDEL

SEQ ID NO: 539 - protein, 519 aa, Artificial Sequence
  source: /note="Description of Artificial Sequence: Synthetic polypeptide"
MQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGSTSGSGKPGSGEGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 540 - protein, 521 aa, Artificial Sequence; identical to SEQ ID NO: 517
  source: /note="Description of Artificial Sequence: Synthetic polypeptide"

SEQ ID NO: 541 - protein, 521 aa, Artificial Sequence; identical to SEQ ID NO: 517
  source: /note="Description of Artificial Sequence: Synthetic polypeptide"

SEQ ID NO: 542 - protein, 521 aa, Artificial Sequence; identical to SEQ ID NO: 517
  source: /note="Description of Artificial Sequence: Synthetic polypeptide"

SEQ ID NO: 543 - protein, 522 aa, Artificial Sequence
  source: /note="Description of Artificial Sequence: Synthetic polypeptide"
MQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 544 - protein, 521 aa, Artificial Sequence
  source: /note="Description of Artificial Sequence: Synthetic polypeptide"
MEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGSTSGSGKPGSGEGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 545 - protein, 531 aa, Artificial Sequence
  source: /note="Description of Artificial Sequence: Synthetic polypeptide"
MEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 546 - protein, 530 aa, Artificial Sequence
  source: /note="Description of Artificial Sequence: Synthetic polypeptide"
MQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGGGSGGGGSGGGGSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSEFPKPSTPPGSSGGILGFVFTLGAPKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 547 - protein, 520 aa, Artificial Sequence
  source: /note="Description of Artificial Sequence: Synthetic polypeptide"
MQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGSTSGSGKPGSGEGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 548 - protein, 382 aa, Artificial Sequence
  source: /note="Description of Artificial Sequence: Synthetic polypeptide"
ASVSDVPRDLEVVAATPTSLLISWCRQRCADSYRITYGETGGNSPVQEFTVPGSWKTATISGLKPGVDYTITVYVVTHYYGWDRYSHPISINYRTGSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAANLVPMVATV

SEQ ID NO: 549 - protein, 525 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 550 - protein, 522 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLMQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 551 - protein, 517 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSS

SEQ ID NO: 552 - protein, 517 aa, Artificial Sequence; identical to SEQ ID NO: 551
  source: /note="Description of Artificial Sequence: Synthetic polypeptide"

SEQ ID NO: 553 - protein, 521 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSS

SEQ ID NO: 554 - protein, 521 aa, Artificial Sequence; identical to SEQ ID NO: 553
  source: /note="Description of Artificial Sequence: Synthetic polypeptide"

SEQ ID NO: 555 - protein, 525 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKGSTSGSGKPGSGEGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSS

SEQ ID NO: 556 - protein, 525 aa, Artificial Sequence; identical to SEQ ID NO: 555
  source: /note="Description of Artificial Sequence: Synthetic polypeptide"

SEQ ID NO: 557 - protein, 527 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKGSTSGSGKPGSGEGSTKGQVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSS

SEQ ID NO: 558 - protein, 527 aa, Artificial Sequence; identical to SEQ ID NO: 557
  source: /note="Description of Artificial Sequence: Synthetic polypeptide"

SEQ ID NO: 559 - protein, 394 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAAHHSEDPSSKAPKAPGILGFVFTLEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSS

SEQ ID NO: 560 - protein, 395 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSS

SEQ ID NO: 561 - protein, 394 aa, Artificial Sequence; identical to SEQ ID NO: 559
  source: /note="Description of Artificial Sequence: Synthetic polypeptide"

SEQ ID NO: 562 - protein, 395 aa, Artificial Sequence; identical to SEQ ID NO: 560
  source: /note="Description of Artificial Sequence: Synthetic polypeptide"

SEQ ID NO: 563 - protein, 374 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLASVSDVPRDLEVVAATPTSLLISWCRQRCADSYRITYGETGGNSPVQEFTVPGSWKTATISGLKPGVDYTITVYVVTHYYGWDRYSHPISINYRTGS

SEQ ID NO: 564 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 565 - protein, 507 aa, Artificial Sequence
  source: /note="Description of Artificial Sequence: Synthetic polypeptide"
VTEHDTLLYKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 566 - protein, 507 aa, Artificial Sequence
  source: /note="Description of Artificial Sequence: Synthetic polypeptide"
GLDRNSGNYKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 567 - protein, 506 aa, Artificial Sequence
  source: /note="Description of Artificial Sequence: Synthetic polypeptide"
GVMTRGRLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 568 - protein, 507 aa, Artificial Sequence
  source: /note="Description of Artificial Sequence: Synthetic polypeptide"
VYALPLKMLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 569 - protein, 520 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 570 - protein, 519 aa, Artificial Sequence
  source: /note="Description of Artificial Sequence: Synthetic polypeptide"
GILGFVFTLAEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVS

SEQ ID NO: 571 - protein, 520 aa, Artificial Sequence
  source: /note="Description of Artificial Sequence: Synthetic polypeptide"
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 572 - protein, 520 aa, Artificial Sequence
  source: /note="Description of Artificial Sequence: Synthetic polypeptide"
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 573 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSVTEHDTLLY

SEQ ID NO: 574 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 575 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSQYDPVAALF

SEQ ID NO: 576 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSCLGGLLTMV

SEQ ID NO: 577 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSILRGSVAHK

SEQ ID NO: 578 - protein, 520 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 579 - protein, 508 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSNLVPMVATV

SEQ ID NO: 580 - protein, 526 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKGILGFVFTL

SEQ ID NO: 581 - protein, 506 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSNLVPMVATV

SEQ ID NO: 582 - protein, 507 aa, Artificial Sequence; identical to SEQ ID NO: 574
  source: /note="Description of Artificial Sequence: Synthetic polypeptide"

SEQ ID NO: 583 - protein, 520 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKNLVPMVATV

SEQ ID NO: 584 - protein, 508 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKNLVPMVATV

SEQ ID NO: 585 - protein, 521 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKNLVPMVATV

SEQ ID NO: 586 - protein, 400 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDNLVPMVATV

SEQ ID NO: 587 - protein, 516 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSSNLVPMVATV

SEQ ID NO: 588 - protein, 393 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAAHHSEDPSSKAPKAPEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSNLVPMVATV

SEQ ID NO: 589 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSANLVPMVATV

SEQ ID NO: 590 - protein, 383 aa, Artificial Sequence
  source: /note="Description of Artificial Sequence: Synthetic polypeptide"
ASVSDVPRDLEVVAATPTSLLISWCRQRCADSYRITYGETGGNSPVQEFTVPGSWKTATISGLKPGVDYTITVYVVTHYYGWDRYSHPISINYRTGSEFPKPSTPPGSSGGAPKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAAANLVPMVATVNLVPMVATV

SEQ ID NO: 591 - protein, 507 aa, Artificial Sequence; identical to SEQ ID NO: 589
  source: /note="Description of Artificial Sequence: Synthetic polypeptide"

SEQ ID NO: 592 - protein, 498 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAGGGGSGGDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 593 - protein, 520 aa, Artificial Sequence; identical to SEQ ID NO: 569
  source: /note="Description of Artificial Sequence: Synthetic polypeptide"

SEQ ID NO: 594 - protein, 508 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 595 - protein, 526 aa, Artificial Sequence
  source: /note="Description of Artificial Sequence: Synthetic polypeptide"
GILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 596 - protein, 497 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAGGGGSGGDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 597 - protein, 507 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 598 - protein, 520 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 599 - protein, 519 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAGGGGSGGQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSGGGGSGGGGSGGGGSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELK

SEQ ID NO: 600 - protein, 409 aa, Artificial Sequence
  source: /note="Description of Artificial Sequence: Synthetic polypeptide"
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPNLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 601 - protein, 409 aa, Artificial Sequence
  source: /note="Description of Artificial Sequence: Synthetic polypeptide"
GILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 602 - protein, 521 aa, Artificial Sequence
  source: /note="Description of Artificial Sequence: Synthetic polypeptide"
MNLVPMVATVKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 603 - protein, 521 aa, Artificial Sequence; identical to SEQ ID NO: 602
  source: /note="Description of Artificial Sequence: Synthetic polypeptide"

SEQ ID NO: 604 - protein, 521 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 605 - protein, 521 aa, Artificial Sequence; identical to SEQ ID NO: 604
  source: /note="Description of Artificial Sequence: Synthetic polypeptide"

SEQ ID NO: 606 - protein, 521 aa, Artificial Sequence
  source: /note="Description of Artificial Sequence: Synthetic polypeptide"
MGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 607 - protein, 521 aa, Artificial Sequence
  source: /note="Description of Artificial Sequence: Synthetic polypeptide"
MDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 608 - protein, 521 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 609 - protein, 509 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSNLVPMVATV

SEQ ID NO: 610 - protein, 527 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKGILGFVFTL

SEQ ID NO: 611 - protein, 527 aa, Artificial Sequence; identical to SEQ ID NO: 610
  source: /note="Description of Artificial Sequence: Synthetic polypeptide"

SEQ ID NO: 612 - protein, 507 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSNLVPMVATV

SEQ ID NO: 613 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 614 - protein, 520 aa, Artificial Sequence; identical to SEQ ID NO: 572
  source: /note="Description of Artificial Sequence: Synthetic polypeptide"

SEQ ID NO: 615 - protein, 521 aa, Artificial Sequence; identical to SEQ ID NO: 608
  source: /note="Description of Artificial Sequence: Synthetic polypeptide"

SEQ ID NO: 616 - protein, 525 aa, Artificial Sequence
  source: /note="Description of Artificial Sequence: Synthetic polypeptide"
MDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 617 - protein, 525 aa, Artificial Sequence; identical to SEQ ID NO: 616
  source: /note="Description of Artificial Sequence: Synthetic polypeptide"

SEQ ID NO: 618 - protein, 521 aa, Artificial Sequence
  source: /note="Description of Artificial Sequence: Synthetic polypeptide"
MDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 619 - protein, 521 aa, Artificial Sequence; identical to SEQ ID NO: 618
  source: /note="Description of Artificial Sequence: Synthetic polypeptide"

SEQ ID NO: 620 - protein, 530 aa, Artificial Sequence
  source: /note="Description of Artificial Sequence: Synthetic polypeptide"
MDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKGSTSGSGKPGSGEGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSAEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 621 - protein, 530 aa, Artificial Sequence; identical to SEQ ID NO: 620
  source: /note="Description of Artificial Sequence: Synthetic polypeptide"

SEQ ID NO: 622 - protein, 531 aa, Artificial Sequence
  source: /note="Description of Artificial Sequence: Synthetic polypeptide"
MDIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKGSTSGSGKPGSGEGSTKGQVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 623 - protein, 531 aa, Artificial Sequence; identical to SEQ ID NO: 622
  source: /note="Description of Artificial Sequence: Synthetic polypeptide"

SEQ ID NO: 624 - protein, 398 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDPSSKAPKAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 625 - protein, 399 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 626 - protein, 407 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDPSSKAPKAPGILGFVFTLGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 627 - protein, 408 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSEFPKPSTPPGSSGGAPGILGFVFTLGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 628 - protein, 414 aa, Artificial Sequence
  source: /note="Description of Artificial Sequence: Synthetic polypeptide"
MAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 629 - protein, 414 aa, Artificial Sequence
  source: /note="Description of Artificial Sequence: Synthetic polypeptide"
MAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAAKDEL

SEQ ID NO: 630 - protein, 519 aa, Artificial Sequence
  source: /note="Description of Artificial Sequence: Synthetic polypeptide"
MQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGSTSGSGKPGSGEGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 631 - protein, 521 aa, Artificial Sequence; identical to SEQ ID NO: 608
  source: /note="Description of Artificial Sequence: Synthetic polypeptide"

SEQ ID NO: 632 - protein, 521 aa, Artificial Sequence; identical to SEQ ID NO: 608
  source: /note="Description of Artificial Sequence: Synthetic polypeptide"

SEQ ID NO: 633 - protein, 521 aa, Artificial Sequence; identical to SEQ ID NO: 608
  source: /note="Description of Artificial Sequence: Synthetic polypeptide"

SEQ ID NO: 634 - protein, 522 aa, Artificial Sequence
  source: /note="Description of Artificial Sequence: Synthetic polypeptide"
MQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 635 - protein, 521 aa, Artificial Sequence
  source: /note="Description of Artificial Sequence: Synthetic polypeptide"
MEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGSTSGSGKPGSGEGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 636 - protein, 531 aa, Artificial Sequence
  source: /note="Description of Artificial Sequence: Synthetic polypeptide"
MEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 637 - protein, 530 aa, Artificial Sequence
  source: /note="Description of Artificial Sequence: Synthetic polypeptide"
MQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGGGSGGGGSGGGGSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSEFPKPSTPPGSSGGILGFVFTLGAPKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 638 - protein, 520 aa, Artificial Sequence
  source: /note="Description of Artificial Sequence: Synthetic polypeptide"
MQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGSTSGSGKPGSGEGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 639 - protein, 382 aa, Artificial Sequence
  source: /note="Description of Artificial Sequence: Synthetic polypeptide"
ASVSDVPRDLEVVAATPTSLLISWCRQRCADSYRITYGETGGNSPVQEFTVPGSWKTATISGLKPGVDYTITVYVVTHYYGWDRYSHPISINYRTGSEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAANLVPMVATV

SEQ ID NO: 640 - protein, 525 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAKDEL

SEQ ID NO: 641 - protein, 522 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLMQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 642 - protein, 517 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSS

SEQ ID NO: 643 - protein, 517 aa, Artificial Sequence; identical to SEQ ID NO: 642
  source: /note="Description of Artificial Sequence: Synthetic polypeptide"

SEQ ID NO: 644 - protein, 521 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSS

SEQ ID NO: 645 - protein, 521 aa, Artificial Sequence; identical to SEQ ID NO: 644
  source: /note="Description of Artificial Sequence: Synthetic polypeptide"

SEQ ID NO: 646 - protein, 525 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKGSTSGSGKPGSGEGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSS

SEQ ID NO: 647 - protein, 525 aa, Artificial Sequence; identical to SEQ ID NO: 646
  source: /note="Description of Artificial Sequence: Synthetic polypeptide"

SEQ ID NO: 648 - protein, 527 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKGSTSGSGKPGSGEGSTKGQVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSS

SEQ ID NO: 649 - protein, 527 aa, Artificial Sequence; identical to SEQ ID NO: 648
  source: /note="Description of Artificial Sequence: Synthetic polypeptide"

SEQ ID NO: 650 - protein, 394 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAAHHSEDPSSKAPKAPGILGFVFTLEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSS

SEQ ID NO: 651 - protein, 395 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSS

SEQ ID NO: 652 - protein, 394 aa, Artificial Sequence; identical to SEQ ID NO: 650
  source: /note="Description of Artificial Sequence: Synthetic polypeptide"

SEQ ID NO: 653 - protein, 395 aa, Artificial Sequence; identical to SEQ ID NO: 651
  source: /note="Description of Artificial Sequence: Synthetic polypeptide"

SEQ ID NO: 654 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPGILGFVFTLDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 655 - protein, 508 aa, Artificial Sequence; identical to SEQ ID NO: 654
  source: /note="Description of Artificial Sequence: Synthetic polypeptide"

SEQ ID NO: 656 - protein, 507 aa, Artificial Sequence; identical to SEQ ID NO: 407
  source: /note="Description of Artificial Sequence: Synthetic polypeptide"

SEQ ID NO: 657 - protein, 507 aa, Artificial Sequence
  source: /note="Description of Artificial Sequence: Synthetic polypeptide"
VTEHDTLLYKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 658 - protein, 507 aa, Artificial Sequence
  source: /note="Description of Artificial Sequence: Synthetic polypeptide"
GLDRNSGNYKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 659 - protein, 506 aa, Artificial Sequence
  source: /note="Description of Artificial Sequence: Synthetic polypeptide"
GVMTRGRLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 660 - protein, 507 aa, Artificial Sequence
  source: /note="Description of Artificial Sequence: Synthetic polypeptide"
VYALPLKMLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 661 - protein, 520 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 662 - protein, 519 aa, Artificial Sequence
  source: /note="Description of Artificial Sequence: Synthetic polypeptide"
GILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVS

SEQ ID NO: 663 - protein, 520 aa, Artificial Sequence
  source: /note="Description of Artificial Sequence: Synthetic polypeptide"
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 664 - protein, 520 aa, Artificial Sequence
  source: /note="Description of Artificial Sequence: Synthetic polypeptide"
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 665 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSVTEHDTLLY

SEQ ID NO: 666 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 667 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSQYDPVAALF

SEQ ID NO: 668 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSCLGGLLTMV

SEQ ID NO: 669 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSILRGSVAHK

SEQ ID NO: 670 - protein, 520 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSNLVPMVATV

SEQ ID NO: 671 - protein, 508 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSNLVPMVATV

SEQ ID NO: 672 - protein, 526 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKGILGFVFTL

SEQ ID NO: 673 - protein, 506 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSNLVPMVATV

SEQ ID NO: 674 - protein, 507 aa, Artificial Sequence; identical to SEQ ID NO: 666
  source: /note="Description of Artificial Sequence: Synthetic polypeptide"

SEQ ID NO: 675 - protein, 520 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKNLVPMVATV

SEQ ID NO: 676 - protein, 508 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKNLVPMVATV

SEQ ID NO: 677 - protein, 521 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKNLVPMVATV

SEQ ID NO: 678 - protein, 400 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDNLVPMVATV

SEQ ID NO: 679 - protein, 516 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSSNLVPMVATV

SEQ ID NO: 680 - protein, 393 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAAHHSEDPSSKAPKAPEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSNLVPMVATV

SEQ ID NO: 681 - protein, 373 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPASVSDVPRDLEVVAATPTSLLISWCRQRCADSYRITYGETGGNSPVQEFTVPGSWKTATISGLKPGVDYTITVYVVTHYYGWDRYSHPISINYRTGSNLVPMVATV

SEQ ID NO: 682 - protein, 374 aa, Artificial Sequence
  source: /note="Description of Artificial Sequence: Synthetic polypeptide"
ASVSDVPRDLEVVAATPTSLLISWCRQRCADSYRITYGETGGNSPVQEFTVPGSWKTATISGLKPGVDYTITVYVVTHYYGWDRYSHPISINYRTGSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAAANLVPMVATV

SEQ ID NO: 683 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSANLVPMVATV

SEQ ID NO: 684 - protein, 498 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAGGGGSGGDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 685 - protein, 520 aa, Artificial Sequence; identical to SEQ ID NO: 661
  source: /note="Description of Artificial Sequence: Synthetic polypeptide"

SEQ ID NO: 686 - protein, 508 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 687 - protein, 526 aa, Artificial Sequence
  source: /note="Description of Artificial Sequence: Synthetic polypeptide"
GILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 688 - protein, 497 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAGGGGSGGDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 689 - protein, 507 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 690 - protein, 520 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 691 - protein, 519 aa, Artificial Sequence
  source: /note="Description of Artificial Sequence: Synthetic polypeptide"
NLVPMVATVKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAGGGGSGGQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSGGGGSGGGGSGGGGSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELK

SEQ ID NO: 692 - protein, 409 aa, Artificial Sequence
  source: /note="Description of Artificial Sequence: Synthetic polypeptide"
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPNLVPMVATVKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 693 - protein, 409 aa, Artificial Sequence
  source: /note="Description of Artificial Sequence: Synthetic polypeptide"
GILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 694 - protein, 521 aa, Artificial Sequence; identical to SEQ ID NO: 267
  source: /note="Description of Artificial Sequence: Synthetic polypeptide"

SEQ ID NO: 695 - protein, 521 aa, Artificial Sequence; identical to SEQ ID NO: 267
  source: /note="Description of Artificial Sequence: Synthetic polypeptide"

SEQ ID NO: 696 - protein, 521 aa, Artificial Sequence; identical to SEQ ID NO: 269
  source: /note="Description of Artificial Sequence: Synthetic polypeptide"

SEQ ID NO: 697 - protein, 521 aa, Artificial Sequence; identical to SEQ ID NO: 269
  source: /note="Description of Artificial Sequence: Synthetic polypeptide"

SEQ ID NO: 698 - protein, 521 aa, Artificial Sequence; identical to SEQ ID NO: 271
  source: /note="Description of Artificial Sequence: Synthetic polypeptide"

SEQ ID NO: 699 - protein, 521 aa, Artificial Sequence
  source: /note="Description of Artificial Sequence: Synthetic polypeptide"
MDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 700 - protein, 521 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 701 - protein, 509 aa, Artificial Sequence; identical to SEQ ID NO: 274
  source: /note="Description of Artificial Sequence: Synthetic polypeptide"

SEQ ID NO: 702 - protein, 527 aa, Artificial Sequence; identical to SEQ ID NO: 275
  source: /note="Description of Artificial Sequence: Synthetic polypeptide"

SEQ ID NO: 703 - protein, 527 aa, Artificial Sequence; identical to SEQ ID NO: 275
  source: /note="Description of Artificial Sequence: Synthetic polypeptide"

SEQ ID NO: 704 - protein, 507 aa, Artificial Sequence; identical to SEQ ID NO: 277
  source: /note="Description of Artificial Sequence: Synthetic polypeptide"

SEQ ID NO: 705 - protein, 508 aa, Artificial Sequence; identical to SEQ ID NO: 278
  source: /note="Description of Artificial Sequence: Synthetic polypeptide"

SEQ ID NO: 706 - protein, 520 aa, Artificial Sequence; identical to SEQ ID NO: 664
  source: /note="Description of Artificial Sequence: Synthetic polypeptide"

SEQ ID NO: 707 - protein, 521 aa, Artificial Sequence; identical to SEQ ID NO: 700
  source: /note="Description of Artificial Sequence: Synthetic polypeptide"

SEQ ID NO: 708 - protein, 525 aa, Artificial Sequence
  source: /note="Description of Artificial Sequence: Synthetic polypeptide"
MDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAKDEL

SEQ ID NO: 709 - protein, 525 aa, Artificial Sequence; identical to SEQ ID NO: 708
  source: /note="Description of Artificial Sequence: Synthetic polypeptide"

SEQ ID NO: 710 - protein, 521 aa, Artificial Sequence
  source: /note="Description of Artificial Sequence: Synthetic polypeptide"
MDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSSEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAKDEL

SEQ ID NO: 711 - protein, 521 aa, Artificial Sequence; identical to SEQ ID NO: 710
  source: /note="Description of Artificial Sequence: Synthetic polypeptide"

SEQ ID NO: 712 - protein, 530 aa, Artificial Sequence
  source: /note="Description of Artificial Sequence: Synthetic polypeptide"
MDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKGSTSGSGKPGSGEGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSAEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAKDEL

SEQ ID NO: 713 - protein, 530 aa, Artificial Sequence; identical to SEQ ID NO: 712
  source: /note="Description of Artificial Sequence: Synthetic polypeptide"

SEQ ID NO: 714 - protein, 531 aa, Artificial Sequence
  source: /note="Description of Artificial Sequence: Synthetic polypeptide"
MDIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKGSTSGSGKPGSGEGSTKGQVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSSEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAKDEL

SEQ ID NO: 715 - protein, 531 aa, Artificial Sequence; identical to SEQ ID NO: 714
  source: /note="Description of Artificial Sequence: Synthetic polypeptide"

SEQ ID NO: 716 - protein, 398 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDPSSKAPKAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAKDEL

SEQ ID NO: 717 - protein, 399 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAKDEL

SEQ ID NO: 718 - protein, 407 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSAHHSEDPSSKAPKAPGILGFVFTLGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAKDEL

SEQ ID NO: 719 - protein, 408 aa, Artificial Sequence
  source: /note="Description of Artificial Sequence: Synthetic polypeptide"
MEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSEFPKPSTPPGSSGGAPGILGFVFTLGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAKDEL

SEQ ID NO: 720 - protein, 414 aa, Artificial Sequence
  source: /note="Description of Artificial Sequence: Synthetic polypeptide"
MAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAKDEL

SEQ ID NO: 721 - protein, 414 aa, Artificial Sequence
  source: /note="Description of Artificial Sequence: Synthetic polypeptide"
MAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAKDEL

SEQ ID NO: 722 - protein, 519 aa, Artificial Sequence
  source: /note="Description of Artificial Sequence: Synthetic polypeptide"
MQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGSTSGSGKPGSGEGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 723 - protein, 521 aa, Artificial Sequence; identical to SEQ ID NO: 700
  source: /note="Description of Artificial Sequence: Synthetic polypeptide"

SEQ ID NO: 724 - protein, 521 aa, Artificial Sequence; identical to SEQ ID NO: 700
  source: /note="Description of Artificial Sequence: Synthetic polypeptide"

SEQ ID NO: 725 - protein, 521 aa, Artificial Sequence; identical to SEQ ID NO: 700
  source: /note="Description of Artificial Sequence: Synthetic polypeptide"

SEQ ID NO: 726 - protein, 522 aa, Artificial Sequence
  source: /note="Description of Artificial Sequence: Synthetic polypeptide"
MQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 727 - protein, 521 aa, Artificial Sequence
  source: /note="Description of Artificial Sequence: Synthetic polypeptide"
MEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGSTSGSGKPGSGEGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 728 - protein, 531 aa, Artificial Sequence
  source: /note="Description of Artificial Sequence: Synthetic polypeptide"
MEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 729 - protein, 530 aa, Artificial Sequence
  source: /note="Description of Artificial Sequence: Synthetic polypeptide"
MQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGGGSGGGGSGGGGSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSEFPKPSTPPGSSGGILGFVFTLGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 730 - protein, 520 aa, Artificial Sequence
  source: /note="Description of Artificial Sequence: Synthetic polypeptide"
MQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGSTSGSGKPGSGEGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 731 - protein, 373 aa, Artificial Sequence
  source: /note="Description of Artificial Sequence: Synthetic polypeptide"
ASVSDVPRDLEVVAATPTSLLISWCRQRCADSYRITYGETGGNSPVQEFTVPGSWKTATISGLKPGVDYTITVYVVTHYYGWDRYSHPISINYRTGSEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 732 - protein, 781 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAACITGDALVALPEGESVRIADIVPGARPNSDNAIDLKVLDRHGNPVLADRLFHSGEHPVYTVRTVEGLRVTGTANHPLLCLVDVAGVPTLLWKLIDEIKPGDYAVIQRSAFSVDCAGFARGKPEFAPTTYTVGVPGLVRFLEAHHRDPDAQAIADELTDGRFYYAKVASVTDAGVQPVYSLRVDTADHAFITNGFVSHATGLTGLNSGLTTNPGVSAWQVNTAYTAGQLVTYNGKTYKCLQPHTSLAGWEPSNVPALWQLQ

SEQ ID NO: 733 - protein, 781 aa, Artificial Sequence; identical to SEQ ID NO: 732
  source: /note="Description of Artificial Sequence: Synthetic polypeptide"

SEQ ID NO: 734 - protein, 525 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAKDEL

SEQ ID NO: 735 - protein, 522 aa, Artificial Sequence; identical to SEQ ID NO: 287
  source: /note="Description of Artificial Sequence: Synthetic polypeptide"

SEQ ID NO: 736 - protein, 517 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPGILGFVFTLDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSS

SEQ ID NO: 737 - protein, 517 aa, Artificial Sequence; identical to SEQ ID NO: 736
  source: /note="Description of Artificial Sequence: Synthetic polypeptide"

SEQ ID NO: 738 - protein, 521 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPGILGFVFTLDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSS

SEQ ID NO: 739 - protein, 521 aa, Artificial Sequence; identical to SEQ ID NO: 738
  source: /note="Description of Artificial Sequence: Synthetic polypeptide"

SEQ ID NO: 740 - protein, 525 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPGILGFVFTLDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKGSTSGSGKPGSGEGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSS

SEQ ID NO: 741 - protein, 525 aa, Artificial Sequence; identical to SEQ ID NO: 740
  source: /note="Description of Artificial Sequence: Synthetic polypeptide"

SEQ ID NO: 742 - protein, 527 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPGILGFVFTLDIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKGSTSGSGKPGSGEGSTKGQVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSS

SEQ ID NO: 743 - protein, 527 aa, Artificial Sequence; identical to SEQ ID NO: 742
  source: /note="Description of Artificial Sequence: Synthetic polypeptide"

SEQ ID NO: 744 - protein, 394 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAAHHSEDPSSKAPKAPGILGFVFTLEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSS

SEQ ID NO: 745 - protein, 395 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPGILGFVFTLEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSS

SEQ ID NO: 746 - protein, 394 aa, Artificial Sequence; identical to SEQ ID NO: 744
  source: /note="Description of Artificial Sequence: Synthetic polypeptide"

SEQ ID NO: 747 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPGILGFVFTLDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 748 - protein, 508 aa, Artificial Sequence; identical to SEQ ID NO: 747
  source: /note="Description of Artificial Sequence: Synthetic polypeptide"

SEQ ID NO: 749 - protein, 517 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPGILGFVFTLDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSANLVPMVATV

SEQ ID NO: 750 - protein, 4 aa, Artificial Sequence
  source: /note="Description of Artificial Sequence: Synthetic peptide"
KDEL

SEQ ID NO: 751 - protein, 4 aa, Artificial Sequence
  source: /note="Description of Artificial Sequence: Synthetic peptide"
HDEF

SEQ ID NO: 752 - protein, 4 aa, Artificial Sequence
  source: /note="Description of Artificial Sequence: Synthetic peptide"
HDEL

SEQ ID NO: 753 - protein, 4 aa, Artificial Sequence
  source: /note="Description of Artificial Sequence: Synthetic peptide"
RDEF

SEQ ID NO: 754 - protein, 4 aa, Artificial Sequence
  source: /note="Description of Artificial Sequence: Synthetic peptide"
RDEL

SEQ ID NO: 755 - protein, 4 aa, Artificial Sequence
  source: /note="Description of Artificial Sequence: Synthetic peptide"
WDEL

SEQ ID NO: 756 - protein, 4 aa, Artificial Sequence
  source: /note="Description of Artificial Sequence: Synthetic peptide"
YDEL

SEQ ID NO: 757 - protein, 4 aa, Artificial Sequence
  source: /note="Description of Artificial Sequence: Synthetic peptide"
HEEF

SEQ ID NO: 758 - protein, 4 aa, Artificial Sequence
  source: /note="Description of Artificial Sequence: Synthetic peptide"
HEEL

SEQ ID NO: 759 - protein, 4 aa, Artificial Sequence
  source: /note="Description of Artificial Sequence: Synthetic peptide"
KEEL

SEQ ID NO: 760 - protein, 4 aa, Artificial Sequence
  source: /note="Description of Artificial Sequence: Synthetic peptide"
REEL

SEQ ID NO: 761 - protein, 4 aa, Artificial Sequence
  source: /note="Description of Artificial Sequence: Synthetic peptide"
KAEL

SEQ ID NO: 762 - protein, 4 aa, Artificial Sequence
  source: /note="Description of Artificial Sequence: Synthetic peptide"
KCEL

SEQ ID NO: 763 - protein, 4 aa, Artificial Sequence
  source: /note="Description of Artificial Sequence: Synthetic peptide"
KFEL

SEQ ID NO: 764 - protein, 4 aa, Artificial Sequence
  source: /note="Description of Artificial Sequence: Synthetic peptide"
KGEL

SEQ ID NO: 765 - protein, 4 aa, Artificial Sequence
  source: /note="Description of Artificial Sequence: Synthetic peptide"
KHEL

SEQ ID NO: 766 - protein, 4 aa, Artificial Sequence
  source: /note="Description of Artificial Sequence: Synthetic peptide"
KLEL

SEQ ID NO: 767 - protein, 4 aa, Artificial Sequence
  source: /note="Description of Artificial Sequence: Synthetic peptide"
KNEL

SEQ ID NO: 768 - protein, 4 aa, Artificial Sequence
  source: /note="Description of Artificial Sequence: Synthetic peptide"
KQEL

SEQ ID NO: 769 - protein, 4 aa, Artificial Sequence
  source: /note="Description of Artificial Sequence: Synthetic peptide"
KREL

SEQ ID NO: 770 - protein, 4 aa, Artificial Sequence
  source: /note="Description of Artificial Sequence: Synthetic peptide"
KSEL

SEQ ID NO: 771 - protein, 4 aa, Artificial Sequence
  source: /note="Description of Artificial Sequence: Synthetic peptide"
KVEL

SEQ ID NO: 772 - protein, 4 aa, Artificial Sequence
  source: /note="Description of Artificial Sequence: Synthetic peptide"
KWEL

SEQ ID NO: 773 - protein, 4 aa, Artificial Sequence
  source: /note="Description of Artificial Sequence: Synthetic peptide"
KYEL

SEQ ID NO: 774 - protein, 4 aa, Artificial Sequence
  source: /note="Description of Artificial Sequence: Synthetic peptide"
KEDL

SEQ ID NO: 775 - protein, 4 aa, Artificial Sequence
  source: /note="Description of Artificial Sequence: Synthetic peptide"
KIEL

SEQ ID NO: 776 - protein, 4 aa, Artificial Sequence
  source: /note="Description of Artificial Sequence: Synthetic peptide"
DKEL

SEQ ID NO: 777 - protein, 4 aa, Artificial Sequence
  source: /note="Description of Artificial Sequence: Synthetic peptide"
FDEL

SEQ ID NO: 778 - protein, 4 aa, Artificial Sequence
  source: /note="Description of Artificial Sequence: Synthetic peptide"
KDEF

SEQ ID NO: 779 - protein, 4 aa, Artificial Sequence
  source: /note="Description of Artificial Sequence: Synthetic peptide"
KKEL

SEQ ID NO: 780 - protein, 4 aa, Artificial Sequence
  source: /note="Description of Artificial Sequence: Synthetic peptide"
HADL

SEQ ID NO: 781 - protein, 4 aa, Artificial Sequence
  source: /note="Description of Artificial Sequence: Synthetic peptide"
HAEL

SEQ ID NO: 782 - protein, 4 aa, Artificial Sequence
  source: /note="Description of Artificial Sequence: Synthetic peptide"
HIEL

SEQ ID NO: 783 - protein, 4 aa, Artificial Sequence
  source: /note="Description of Artificial Sequence: Synthetic peptide"
HNEL

SEQ ID NO: 784 - protein, 4 aa, Artificial Sequence
  source: /note="Description of Artificial Sequence: Synthetic peptide"
HTEL

SEQ ID NO: 785 - protein, 4 aa, Artificial Sequence
  source: /note="Description of Artificial Sequence: Synthetic peptide"
KTEL

SEQ ID NO: 786 - protein, 4 aa, Artificial Sequence
  source: /note="Description of Artificial Sequence: Synthetic peptide"
HVEL

SEQ ID NO: 787 - protein, 4 aa, Artificial Sequence
  source: /note="Description of Artificial Sequence: Synthetic peptide"
NDEL

SEQ ID NO: 788 - protein, 4 aa, Artificial Sequence
  source: /note="Description of Artificial Sequence: Synthetic peptide"
QDEL

SEQ ID NO: 789 - protein, 4 aa, Artificial Sequence
  source: /note="Description of Artificial Sequence: Synthetic peptide"
REDL

SEQ ID NO: 790 - protein, 4 aa, Artificial Sequence
  source: /note="Description of Artificial Sequence: Synthetic peptide"
RNEL

SEQ ID NO: 791 - protein, 4 aa, Artificial Sequence
  source: /note="Description of Artificial Sequence: Synthetic peptide"
RTDL

SEQ ID NO: 792 - protein, 4 aa, Artificial Sequence
  source: /note="Description of Artificial Sequence: Synthetic peptide"
RTEL

SEQ ID NO: 793 - protein, 4 aa, Artificial Sequence
  source: /note="Description of Artificial Sequence: Synthetic peptide"
SDEL

SEQ ID NO: 794 - protein, 4 aa, Artificial Sequence
  source: /note="Description of Artificial Sequence: Synthetic peptide"
TDEL

SEQ ID NO: 795 - protein, 4 aa, Artificial Sequence
  source: /note="Description of Artificial Sequence: Synthetic peptide"
SKEL

SEQ ID NO: 796 - protein, 4 aa, Artificial Sequence
  source: /note="Description of Artificial Sequence: Synthetic peptide"
STEL

SEQ ID NO: 797 - protein, 4 aa, Artificial Sequence
  source: /note="Description of Artificial Sequence: Synthetic peptide"
EDEL

SEQ ID NO: 798 - protein, 9 aa, Artificial Sequence
  source: /note="Description of Artificial Sequence: Synthetic peptide"
RMFPNAPYL

SEQ ID NO: 799 - protein, 5 aa, Artificial Sequence
  Description of Artificial Sequence: Synthetic peptide
GGGGC

SEQ ID NO: 800 - protein, 6 aa, Artificial Sequence
  Description of Artificial Sequence: Synthetic peptide
SGGGGC

The invention is claimed as follows:

1. A cell targeting molecule comprising:
   i) a Shiga toxin effector polypeptide comprising an amino acid sequence having at least 90% identity to amino acids 1 to 251 of SEQ ID NO: 1;
      wherein the effector polypeptide comprises amino acid substitutions V54I, R55L, I57F, P59F, E60T, E61L, S45I, G110A, R188A, C242S, R248A and R251A in SEQ ID NO: 1; and
      wherein the effector polypeptide comprises an asparagine at the amino acid residue corresponding to position 75 of SEQ ID NO: 1, a tyrosine at the amino acid residue corresponding to position 77 of SEQ ID NO: 1, a tyrosine at the amino acid residue corresponding to position 114 of SEQ ID NO: 1, a glutamate at the amino acid residue corresponding to position 167 of SEQ ID NO: 1, an arginine at the amino acid residue corresponding to position 170 of SEQ ID NO: 1, an arginine at the amino acid residue corresponding to position 176 of SEQ ID NO: 1, and a tryptophan at the amino acid residue corresponding to position 203 of SEQ ID NO: 1;
   ii) a binding region capable of binding at least one extracellular target molecule wherein the binding region is positioned carboxy-terminal to the carboxy-terminus of the Shiga toxin effector polypeptide; and
   iii) at least one heterologous, CD8+ T-cell epitope cargo which is not embedded or inserted in the Shiga toxin effector polypeptide, wherein the at least one heterologous, CD8+ T-cell epitope cargo is positioned carboxy-terminal to the carboxy-terminus of the Shiga toxin effector polypeptide and/or the carboxy-terminus of the binding region.

2. The cell targeting molecule according to claim 1, wherein the Shiga toxin effector polypeptide has at least 95% sequence identity to amino acids 1 to 251 of SEQ ID NO: 1.

3. The cell targeting molecule of claim 1, wherein the binding region comprises an immunoglobulin domain.

4. The cell targeting molecule of claim 3, wherein the immunoglobulin domain is an autonomous $V_H$ domain; single-domain antibody domain (sdAb); camelid $V_HH$ fragment; $V_H$ domain fragment; heavy-chain antibody domain; immunoglobulin new antigen receptor (IgNAR); $V_{NAR}$ fragment; single-chain variable (scFv) fragment; nanobody; antibody variable domain (Fv) fragment; permutated Fv (pFv); single chain Fv-$C_H3$ minibody; dimeric $C_H2$ domain fragment ($C_H2D$); Fc antigen binding domain (Fcab); small modular immunopharmaceutical (SMIP) domain; scFv-Fc fusion; one-arm single-chain Fab construct; diabody; triabody; tetrabody; disulfide-stabilized antibody variable (Fv) fragment; disulfide-stabilized antigen-binding (Fab) fragment consisting of $V_L$, $V_H$, $C_L$ and $C_H1$ domains; bivalent nanobody; bivalent minibody; bivalent $F(ab')_2$ fragment (Fab dimer); bispecific tandem $V_HH$ fragment; bispecific tandem scFv fragment; bispecific nanobody; bispecific minibody; or one-arm single-chain Fab heterodimeric bispecific construct.

5. The cell targeting molecule of claim 1, comprising a linker peptide having an amino acid sequence of any one of SEQ ID NO: 246-251.

6. The cell targeting molecule of claim 1, comprising a linker peptide having an amino acid sequence of SEQ ID NO: 246.

7. The cell targeting molecule of claim 1, comprising a linker peptide having an amino acid sequence of SEQ ID NO: 251.

8. The cell targeting molecule of claim 1, wherein the at least one heterologous, CD8+ T-cell epitope cargo has an amino acid sequence according to any one of SEQ ID NO: 19-27.

9. The cell targeting molecule of claim 1, wherein the at least one heterologous, CD8+ T-cell epitope cargo has an amino acid sequence according to SEQ ID NO: 19.

10. The cell targeting molecule of claim 1, wherein the at least one heterologous, CD8+ T-cell epitope cargo has an amino acid sequence according to SEQ ID NO: 21.

11. The cell targeting molecule of claim 1, wherein the at least one heterologous, CD8+ T-cell epitope cargo has an amino acid sequence according to SEQ ID NO: 23.

12. The cell targeting molecule of claim 1, wherein the at least one heterologous, CD8+ T-cell epitope cargo has an amino acid sequence according to SEQ ID NO: 24.

13. The cell targeting molecule of claim 1, wherein the at least one heterologous, CD8+ T-cell epitope cargo has an amino acid sequence according to SEQ ID NO: 25.

14. The cell targeting molecule of claim 1, wherein the at least one heterologous, CD8+ T-cell epitope cargo has an amino acid sequence according to SEQ ID NO: 26.

15. A pharmaceutical composition comprising the cell targeting molecule of claim 1 and a pharmaceutically acceptable excipient or carrier.

* * * * *